US 10,934,362 B2

United States Patent
Kannan et al.

(10) Patent No.: US 10,934,362 B2
(45) Date of Patent: Mar. 2, 2021

(54) BI-SPECIFIC ANTI-CGRP RECEPTOR/PAC1 RECEPTOR ANTIGEN BINDING PROTEINS AND USES THEREOF

(71) Applicant: AMGEN INC., Thousand Oaks, CA (US)

(72) Inventors: Gunasekaran Kannan, Daly City, CA (US); Ling Liu, Thousand Oaks, CA (US); Edward J. Belouski, Thousand Oaks, CA (US); Cen Xu, Newbury Park, CA (US)

(73) Assignee: AMGEN INC., Thousand Oaks, CA (US)

( * ) Notice: Subject to any disclaimer, the term of this patent is extended or adjusted under 35 U.S.C. 154(b) by 196 days.

(21) Appl. No.: 15/511,176

(22) PCT Filed: Sep. 15, 2015

(86) PCT No.: PCT/US2015/050115
§ 371 (c)(1),
(2) Date: Mar. 14, 2017

(87) PCT Pub. No.: WO2016/044224
PCT Pub. Date: Mar. 24, 2016

(65) Prior Publication Data
US 2017/0306033 A1    Oct. 26, 2017

Related U.S. Application Data

(60) Provisional application No. 62/050,737, filed on Sep. 15, 2014.

(51) Int. Cl.
*C07K 16/28*      (2006.01)
*C07K 16/18*      (2006.01)

(52) U.S. Cl.
CPC .......... *C07K 16/2869* (2013.01); *C07K 16/18* (2013.01); *C07K 16/28* (2013.01); *C07K 2317/31* (2013.01); *C07K 2317/35* (2013.01); *C07K 2317/51* (2013.01); *C07K 2317/515* (2013.01); *C07K 2317/52* (2013.01); *C07K 2317/522* (2013.01); *C07K 2317/524* (2013.01); *C07K 2317/526* (2013.01); *C07K 2317/53* (2013.01); *C07K 2317/55* (2013.01); *C07K 2317/56* (2013.01); *C07K 2317/565* (2013.01); *C07K 2317/622* (2013.01); *C07K 2317/70* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,486,472 A | 1/1996 | Suzuki et al. |
| 5,858,787 A | 1/1999 | Onda et al. |
| 5,866,124 A | 2/1999 | Hardman et al. |
| 5,892,004 A | 4/1999 | Ohtaki et al. |
| 5,973,117 A | 10/1999 | Onda et al. |
| 6,017,533 A | 1/2000 | Moro et al. |
| 6,242,563 B1 | 6/2001 | Dong |
| 6,399,316 B1 | 6/2002 | Onda et al. |
| 6,462,016 B1 | 10/2002 | Wakita et al. |
| 7,193,070 B2 | 3/2007 | Kane et al. |
| 7,288,251 B2 | 10/2007 | Bedian et al. |
| 7,423,128 B2 | 9/2008 | Gazit-Bornstein et al. |
| 7,658,924 B2 | 2/2010 | Oliner et al. |
| 8,592,562 B2 | 11/2013 | Kannan et al. |
| 9,072,777 B2 | 7/2015 | Shindo |
| 9,546,203 B2 | 1/2017 | Kannan |
| 9,862,771 B2 | 1/2018 | Boone et al. |
| 10,011,858 B2 | 7/2018 | Igawa et al. |
| 2002/0155533 A1 | 10/2002 | Onda et al. |
| 2002/0164707 A1 | 11/2002 | Adamou et al. |
| 2002/0182729 A1 | 12/2002 | Dicicco-Bloom et al. |
| 2004/0110170 A1 | 6/2004 | Pisegna et al. |
| 2004/0132101 A1 | 7/2004 | Lazar et al. |
| 2004/0176577 A1 | 9/2004 | Rojer et al. |
| 2005/0129687 A1 | 6/2005 | Vizzard et al. |
| 2005/0142133 A1 | 6/2005 | Lazar et al. |
| 2005/0282252 A1 | 12/2005 | Siegel et al. |
| 2006/0018909 A1 | 1/2006 | Oliner et al. |
| 2006/0062785 A1 | 3/2006 | Freson et al. |
| 2006/0160996 A9 | 7/2006 | Lazar et al. |

(Continued)

FOREIGN PATENT DOCUMENTS

| | | |
|---|---|---|
| CN | 102939303 A | 2/2013 |
| EP | 0 522 159 B1 | 12/2001 |

(Continued)

OTHER PUBLICATIONS

Shen et al., Neuropeptides, 2013; 47: 421-430 (Year: 2013).*

(Continued)

*Primary Examiner* — Christina M Borgeest
(74) *Attorney, Agent, or Firm* — Angela L. Purcell

(57) ABSTRACT

The present invention relates to bispecific antigen binding proteins that are capable of binding to both the human CGRP receptor and the human PAC1 receptor. Pharmaceutical compositions comprising the bispecific antigen binding proteins as well as methods for producing them are also disclosed. Methods of using the bispecific antigen binding proteins to ameliorate or treat conditions associated with the two receptors, such as chronic pain, migraine, and cluster headache, are also described.

43 Claims, 3 Drawing Sheets

Specification includes a Sequence Listing.

(56) References Cited

U.S. PATENT DOCUMENTS

| | | | |
|---|---|---|---|
| 2006/0246071 | A1 | 11/2006 | Green et al. |
| 2007/0054843 | A1 | 3/2007 | Yeomans et al. |
| 2008/0057063 | A1 | 3/2008 | Rinkenberger et al. |
| 2009/0215895 | A1 | 8/2009 | Ferrante et al. |
| 2009/0291900 | A1 | 11/2009 | Yeomans et al. |
| 2010/0015133 | A1 | 1/2010 | Igawa et al. |
| 2010/0112601 | A1 | 5/2010 | Shirakawa et al. |
| 2011/0021426 | A1 | 1/2011 | Toll et al. |
| 2012/0294802 | A1 | 11/2012 | Russo et al. |
| 2013/0196908 | A1 | 8/2013 | Toll et al. |
| 2015/0010560 | A1* | 1/2015 | Xu .............. C07K 16/2869 424/135.1 |
| 2015/0376286 | A1 | 12/2015 | Boone et al. |

FOREIGN PATENT DOCUMENTS

| | | |
|---|---|---|
| EP | 2 048 162 A1 | 4/2009 |
| EP | 1 098 906 B1 | 11/2009 |
| EP | 1 928 484 B1 | 2/2010 |
| EP | 2 161 282 A1 | 3/2010 |
| JP | 2005/503809 | 2/2005 |
| JP | 2007-525495 A | 9/2007 |
| WO | 98/03534 A1 | 1/1998 |
| WO | 00/05260 A1 | 2/2000 |
| WO | 2002/066492 A2 | 8/2002 |
| WO | 2004/014351 A2 | 2/2004 |
| WO | 2004/062684 A | 7/2004 |
| WO | 2004/097421 A2 | 11/2004 |
| WO | 2004/099249 A2 | 11/2004 |
| WO | 2005/073164 A1 | 8/2005 |
| WO | 2005/077072 A2 | 8/2005 |
| WO | 2006/068953 A2 | 6/2006 |
| WO | 2006/134692 A1 | 12/2006 |
| WO | 2007/022070 A2 | 2/2007 |
| WO | 2007/025249 A2 | 3/2007 |
| WO | 2007/045927 A2 | 4/2007 |
| WO | 2007/048026 A2 | 4/2007 |
| WO | 2007/054809 A2 | 5/2007 |
| WO | 2007/076336 A1 | 7/2007 |
| WO | 2008/132453 A1 | 11/2008 |
| WO | 2009/033489 A2 | 3/2009 |
| WO | 2009/109908 A1 | 9/2009 |
| WO | 2010/012911 A1 | 2/2010 |
| WO | 2010/066125 A1 | 6/2010 |
| WO | 2010/075238 A1 | 7/2010 |
| WO | WO2010/145792 * 12/2010 ............. C07K 16/46 |
| WO | 2011/017122 A1 | 2/2011 |
| WO | 2011/024113 A1 | 3/2011 |
| WO | 2011/076781 A1 | 6/2011 |
| WO | 2012/125850 A1 | 9/2012 |
| WO | 2013/093809 A1 | 6/2013 |
| WO | 2013/177062 A2 | 11/2013 |
| WO | 2014/081955 A1 | 5/2014 |
| WO | 2014/144632 A2 | 9/2014 |

OTHER PUBLICATIONS

Rubio-Beltrán et al., The Journal of Headache and Pain, 2018; 19: 64 (Year: 2018).*
Piche-Nicholas et al., MAbs. 2018; 10: 81-94. doi: 10.1080/19420862. 2017.1389355 (Year: 2018).*
Winkler, Ther. Deliv. 2013; 4: 791-809 (Year: 2013).*
Jafarlou et al., Journal of Biological Regulators & Homeostatic Agents, 2016: 30: 315-321 (Year: 2016).*
Lloyd et al., Protein Engineering, Design & Selection, 2009; 22(3):159-168 (Year: 2009).*
Liu et al., JBC, 2015; 290: 7535-7562 (Year: 2015).*
Singapore Search Report and Written Opinion dated Sep. 7, 2012 for 201104555-6.
Bendig, Mary M. (1995), "Humanization of rodent monoclonal antibodies by CDR grafting", Methods: A Companion to Methods in Enzymology, 9:83-93.

Bourgault et al. (2009), "Molecular and conformational determinants of pituitary adenylate cyclase-activating polypeptide (PACAP) for activation of the PAC1 receptor", J. Med. Chem., 52: 3308-3316.
Calcitonin receptor-like [*Homo sapiens*], NCBI Ref. Seq.: NP 005786.1 (Feb. 3, 2008).
Chauhan, M. et al. (2004), "Studies on the effects of the N-terminal domain antibodies of calcitonin receptor-like receptor and receptor activity-modifying protein 1 on calcitonin gene-related peptide-induced vasorelaxation in rat uterine artery", Biol.Reproduction, 70:1658-1663.
Colman, P.M. (1994), "Effects of amino acid sequence changes on antibody-antigen interactions", Research in Immunology, 145:33-36.
Committee on Methods of Producing Monoclonal Antibodies (1999), "Monoclonal antibody production", National Academy Press, Washington DC.
Corvera, Carlos U. et al. (2005), "Localization of calcitonin receptor-like receptor (CLR) and calcitonin gene-related peptide (CGRP) in human gut", Database Biosis, Ann. Mtg. Amer. Gastroenterol. Assoc./Digestive Disease Wk., Chicago, IL, 128(4, S2):A361.
Cottrell et al. (2005), "Localization of calcitonin receptor-like receptor and receptor activity modifying protein 1 in enteric neuron, dorsal root ganglia and the spinal cord of the rat", J. Comparative Neurol. 490:239-255.
Davis et al. (2008), "The tortuous road to an ideal CGRP function blocker for the treatment of migraine", Current Topics in Med. Chem., 8(16)1468-1479.
Dong, Yuan-Lin et al. (2004), "Involvement of calcitonin gene-related peptide in control of human fetoplacental vascular tone", Amer. J. Physiol. Heart Circulation Physiol., 286:H230-H239.
Durham et al. (2004), "CGRP-receptor antagonists—a fresh approach to migraine therapy?", N. Eng. J. Med., 350(11):1073-1075.
Evans et al. (2000), "CGRP-RCP, a novel protein required for signal transduction at calcitonin gene-related peptide and adrenomedullin receptors", 275(40):31438-31443.
Goetzl et al., "PAC1 and VIP receptors", pp. 2249-2253, DOI:10. 1006/rwcy.2000.23009.
Guirland et al.(2003), "Direct cAMP signaling through G-protein-coupled receptors mediates growth cone attraction induced by pituitary adenylate cyclase-activating polypeptide", J. Neurosci., 23(6):2274-2283.
Hay, D.L. (2007), "What makes a $CGRP_2$ receptor?", Clin. Exper. Pharmacol. Physiol., 34:963-971, doi:10.1111/j.1440-1681.2007. 04703.x.
Inooka, Hiroshi et al. (2001), "Conformation of a peptide ligand bound to its G-protein coupled receptor", Nature Struct. Biol., 8(2):161-165.
ISR and Written Opinion for PCT/US2014/029128 dated Oct. 8, 2014.
Johnson, Ginger S. et al. (2014), "Migraine prophylaxis: the race is on", Presentation at Defined Health, webinar.
Kuwasako et al. (2000), "Visualization of the calcitonin receptor-like receptor and its receptor activity-modifying proteins during internalization and recycling", J. Biol. Chem., 275(28):29602-29609.
Laburthe, Marc et al. (2007), "Class II G protein-coupled receptors for VIP and PACAP: structure, models of activation and pharmacology", Peptides, 28:1631-1639.
Lennerz et al. (2008), "Calcitonin receptor-like receptor (CLR), receptor activity-modifying protein 1 (Ramp1), and calcitonin gene-related peptide (CGRP) immunoreactivity in the rat trigeminovascular system: differences between peripheral and central CGRP receptor distribution", J. Comparative Neurol., 507(3):1277-1299.
Lerner et al. (2007), "Maxadilan, a PAC1 receptor agonist from sand flies", Peptides, 28(9):1651-1654, NIH-Public Access.
Mach et al. (2002), "Origins of skeletal pain: sensory and sympathetic innervation for the mouse femur", Neurosci., 113(1):155-166.
McLatchie, L.M. et al. (1998), "RAMPs regulate the transport and ligand specificity of the calcitonin-receptor-like receptor", Nature, 393:333-339.
Moretti, C. (2006), "PACAP and type I PACAP receptors in human prostate cancer tissue", Annals NYAS, 1070(I):440-449.

(56) References Cited

OTHER PUBLICATIONS

Moro et al. (1999), "Functional characterization of structural alterations in the sequence of the vasodilatory peptide maxadilan yields a pituitary adenylate cyclase-activating peptide type 1 receptor-specific antagonist", J. Biol. Chem., 274(33):23103-23110.
Office Action dated Sep. 12, 2012, issued in European Patent Application No. 09775072.3.
Office Action dated Feb. 20, 2014, issued in Japanese Patent Application No. 2011-543606.
Office Action dated Mar. 26, 2014, issued in Chilean Patent Application No. 1578/2011.
Office Action Search Report dated Sep. 19, 2012, issued in Taiwanese Patent Application No. 098144377 (translation).
Olesen, Jes and Ashina, Messoud (2011), "Emerging migraine treatments and drug targets", Trends in Pharm. Sci., 32(6): 353-355.
Paul, William E. (1993), "Fv structure and diversity in three dimensions", Fundamental Immunology, 3rd ed., pp. 292-295.
Poyner et al. (2002), "International union of pharmacology, XXXII. The mammalian calcitonin gene-related peptides, adrenomedullin, amylin, and calcitonin receptors", Pharmacol. Rev., 54(2).
Receptor activity-modifying protein 1 precursor [*Homo sapiens*] NCBI Ref. Seq.: NP 005846.1 (Feb. 3, 2008).
Rudikoff, Stuart et al. (1982), "Single amino acid substitution altering antigen-binding specificity", PNAS USA, 79(6):1979-1983.
Sazinsky S.L. (2008), "Aglycosylated immunoglobulin G1 variants productively engage activating Fc receptors", PNAS, 105(51):20167-20172.
Schulz et al. (2004), "Immunocytochemical identification of VPAC1, VPAC2, and PAC1 receptors in normal and neoplastic human tissues with subtype-specific antibodies", Clin. Cancer Res., 10:8235.
Schytz, et al. (2009),"PACAP38 induces migraine-like attacks in patients with migraine without aura", Brain, 132:16-25.
Schytz, H.W. et al. (2010), "The PACAP receptor: a novel target for migraine treatment", Neurotherap., 7(2):191-196.
Silberstein, SD (2013), "Emerging target-based paradigms to prevent and treat migraine", Nature, 93(1): 78-85.
Taylor, Christopher K. et al. (2006), "Pharmacological characterization of novel α-calcitonin gene related peptide (CGRP) receptor peptide antagonists that are selective for human CGRP receptors", J. Pharmacol. Exper. Therap., 319(2):749-757.
Vaudry et al. (2000), "Pituitary adenylate cyclase-activating polypeptide and its receptors: from structure to functions", Pharmacol. Rev., 52(2):269-324.
Vaudry, David et al. (2009), "Pituitary adenylate cyclase-activating polypeptide and its receptors: 20 years after the discovery", Pharmacol. Rev., 61(3):283-357.
Wimalawansa et al. (1989), "Isolation, purification and raising of monoclonal antibodies for calcitonin gene-related peptide (CGRP) receptor", Reg. Peptides, 26(1).
Written Opinion for PCT/US2009/068858, PCT Searching Authority, dated Mar. 16, 2010.
Written Opinion for PCT/US2015/050115, Int'l Search Authority, dated Jan. 21, 2016.
Zeller, J. et al. (2008), "CGRP function-blocking antibodies inhibit neurogenic vasodilatation without affecting heart rate or arterial blood pressure in the rat", British J. Pharmacol., 155(7):1093-1103.
Zvirbliene et al. (1999), "Production and characterization of monoclonal antibodies to pituitary adenylate cyclase activating polypeptide type i receptor", Hybridoma, 18(4):335-342.

Ashina et al. (1999), "Plasma levels of substance P, neuropeptide Y and vasoactive intestinal polypeptide in patients with chronic tension-type headache", Pain. 83:541-547.
Berglund et al. (2008), "The epitope space of the human proteome", Protein Sci., 17:606-613.
Durham, Paul L. (2008), "Inhibition of calcitonin gene-related peptide function: a promising strategy for treating migraine", Headache, 48:1269-1275.
Greenspan et al. (1999), "Defining epitopes: It's not as easy as it seems", Nature Biotech., 17:936-937.
Jiang et al. (2005), "A novel peptide isolated from a phage display peptide library with trastuzumab can mimic antigen epitope of HER-2*", J. Biol. Chem., 280(6):4656-4662.
Perena, M.J. et al. (2000), "Neuroanatomia del dolor", Rev. Soc. Esp. Dolor, 7(Supl II): 5-10.
Perena, M.J. et al. (2000), "Neuroanatomia del dolor", Rev. Soc. Esp. Dolor, 7(Supl II): 5-10. * Machine Translation into English.
Stancoviski et al. (1991), "Mechanistic aspects of the opposing effects of monoclonal antibodies to the ERBB2 receptor on tumor growth", PNAS USA, 88:8691-8695.
Ashina et al. (2000), "Plasma levels of calcitonin gene-related peptide in chronic tension-type headache", Neurol. 55(9):1335-1340.
Bennett et al. (2000), "Alleviation of mechanical and thermal allodynia by $CGRP_{8-37}$ in a rodent model of chronic central pain", Pain, 86(1-2):163-175.
The International Classification of Headache Disorders, $2^{nd}$ ed. (2004), Cephalalgia, 24(Suppl. 1):9-160.
Wyon et al. (2000), "Concentrations of calcitonin gene-related peptide and neuropeptide Y in plasma increase during flushes in postmenopausal women", Menopause, 7(1):25-30.
Bee et al. (2013), "Determining the binding affinity of therapeutic monoclonal antibodies towards their native unpurified antigens in human serum", PLOS One, 8(11)e80501:1-13.
Drake et al. (2004), "Characterizing high-affinity antigen/antibody complexes by kinetic- and equilibrium-based methods", Anal. Biochem., 328(1):35-43.
Drake et al. (2012), "Biacore surface matrix effects on the binding kinetics and affinity of an antigen/antibody complex", Anal. Biochem., 429(1):58-69.
Gunasekaran et al. (2010), "Enhancing Antibody Fc Heterodimer Formation through Electrostatic Steering Effects", J. Biol. Chem., 285(25): 19637-19646.
Heinrich et al. (2010), "Comparison of the results obtained by ELISA and surface plasmon resonance for the determination of antibody affinity", J. Immunol. Methods, 352(1-2):13-22.
Kontermann, R. (2012), "Dual targeting strategies with bispecific antibodies", mAbs, 4(2): 182-197.
Saldanha, Jose W. (2007), "Molecular Engineering I: Humanization", Chapter 6, Handbook of Therapeutic Antibodies, Stefan Dubel ed., pp. 119-144.
Spiess et al. (2015), "Alternative molecular formats and therapeutic applications for bispecific antibodies", Molecular Immunology, 67:95-106.
Booe et al. (2015), "Structural Basis for Receptor Activity-Modifying Protein-Dependent Selective Peptide Recognition by a G Protein-Coupled Receptor", Molecular Cell, 58:1040-1052.
Tepper et al. (2017), "Safety and efficacy of erenumab for preventive treatment of chronic migraine: a randomised, double-blind, placebo-controlled phase 2 trial", Lancet Neurol., 16:425-434.
Almagro and Fransson (2008), "Humanization of antibodies", Frontiers Biosci. 13:1619-1633.

* cited by examiner

BI-SPECIFIC ANTI-CGRP RECEPTOR/PAC1 RECEPTOR ANTIGEN BINDING PROTEINS AND USES THEREOF

CROSS-REFERENCE TO RELATED APPLICATIONS

This application claims the benefit of U.S. Provisional Application No. 62/050,737, filed Sep. 15, 2014, which is hereby incorporated by reference in its entirety.

DESCRIPTION OF THE TEXT FILE SUBMITTED ELECTRONICALLY

The present application contains a Sequence Listing, which has been submitted electronically in ASCII format and is hereby incorporated by reference in its entirety. The computer readable format copy of the Sequence Listing, which was created on Sep. 8, 2015, is named A-1922-WO-PCT_ST25.txt and is 1,091 kilobytes in size.

FIELD OF THE INVENTION

The present invention relates to the field of biopharmaceuticals. In particular, the invention relates to bispecific antigen binding proteins that are capable of specifically binding to human calcitonin gene-related peptide (CGRP) receptor and human pituitary adenylate cyclase-activating polypeptide type I (PAC1) receptor, pharmaceutical compositions comprising the bispecific antigen binding proteins, and methods of producing and using such bispecific antigen binding proteins.

BACKGROUND OF THE INVENTION

Migraine is a complex, common neurological condition that is characterized by severe, episodic attacks of headache and associated features, which may include nausea, vomiting, sensitivity to light, sound or movement. In some patients, the headache is preceded or accompanied by sensory warning signs or symptoms (i.e. auras). The headache pain may be severe and may also be unilateral in certain patients. Migraine attacks are disruptive to daily life and cost billions of dollars each year in missed work days and impaired performance (Modi and Lowder, Am. Fam. Physician, Vol. 73:72-78, 2006).

Migraine is a highly prevalent disease worldwide with approximately 15% of the European population and 12% of the United States population suffering from migraine attacks (Lipton et al, Neurology, Vol. 68:343-349, 2007). Additionally, migraines have been found to be associated with a number of psychiatric and medical comorbidities such as depression and vascular disorders (Buse et al., Neurol. Neurosurg. Psychiatry, Vol. 81:428-432, 2010; Bigal et al., Neurology, Vol. 72:1864-1871, 2009).

Migraine headache is commonly treated acutely, primarily with analgesics and a class of drugs called triptans (Humphrey et al. Ann NY Acad Sci., Vol. 600:587-598, 1990; Houston and Vanhoutte, Drugs, Vol. 31:149-163 1986). The triptans, which are selective serotonin 5-HT1B/1D agonists, are effective drugs for acute migraine and are generally well tolerated, but are contraindicated in the presence of cardiovascular disease due to their potential for coronary vasoconstriction. In addition, many migraine patients do not respond favorably to triptans. In a meta-analysis of 53 trials, up to a third of all people with migraine and 40% of all migraine attacks did not respond to triptans (Ferrari et al., Lancet, Vol. 358:1668-1675, 2001).

Migraine prophylaxis is an area of large unmet medical need. Approximately 40% of the migraine patient population would benefit from preventive therapy (Lipton et al., Neurology, Vol. 68:343-349, 2007). However, only approximately 12% of patients receive any preventive therapy due in part to limited efficacy and significant tolerability and safety issues with available preventive therapies. Topiramate, an anticonvulsant that blocks voltage-dependent sodium channels and certain glutamate receptors (AMPA-kainate), is the medication most often used for migraine prophylaxis in the United States. Topiramate is the only migraine prophylactic agent with demonstrated efficacy in both episodic and chronic migraine patients through randomized placebo-controlled trials (Diener et al., Cephalalgia, Vol. 27:814-823, 2007; Silberstein et al., Headache, Vol. 47:170-180, 2007). However, approximately 50% of patients fail to respond to topiramate and it is poorly tolerated. Common adverse events associated with topiramate treatment include paresthesia, anorexia, and cognitive adverse events, including psychomotor slowing, somnolence, language difficulties, and difficulties with memory and concentration (Brandes et al., JAMA, Vol. 291:965-973, 2004; Adelman et al., Pain Med., Vol. 9:175-185 2008; Silberstein et al., Arch Neurol., Vol. 61:490-495, 2004). In an open-label, flexible-dose study, 20% of patients withdrew from topiramate because of adverse effects (Nelles et al., Headache, Vol. 49:1454-1465, 2009). Thus, migraine sufferers have an urgent medical need for more effective and/or tolerable treatment options.

Calcitonin gene-related peptide (CGRP) belongs to the calcitonin family of peptides, which also includes calcitonin, amylin, and adrenomedullin. CGRP is a 37-amino acid peptide expressed in both the central and peripheral nervous systems, and has been implicated as a key mediator in the initiation and progression of migraine pain. In addition to its ability to act as a vasodilator, CGRP also acts as a neurotransmitter in the trigeminal ganglion and the trigeminal nucleus caudalis, facilitating synaptic transmission and pain responses (Durham et al., Curr Opin Investig Drugs, Vol. 5:731-735, 2004; Zimmermann et al., Brain Res., Vol. 724:238-245, 1996; Wang et al., Proc Natl Acad Sci USA., Vol. 92:11480-11484, 1995; Poyner, Pharmacol. Ther., Vol. 56:23-51, 1992).

The CGRP receptor is a complex composed of the G-protein coupled calcitonin-like receptor (CLR) and a single transmembrane domain protein receptor activity modifying protein (RAMP1). The CGRP receptor complex is located at sites that are relevant to migraine including the cerebrovasculature, the trigeminocervical complex in the brainstem, and the trigeminal ganglion (Zhang et al., J. Neurosci., Vol. 27: 2693-2703, 2007; Storer et al., Br J Pharmacol., Vol. 142:1171-1181, 2004; Oliver et al., J Cereb Blood Flow Metab., Vol. 22:620-629, 2002). Several lines of evidence indicate that CGRP is a potent vasodilator and nociceptive modulator that has been associated with migraine pathophysiology: (1) it is expressed in the trigeminal system, which is implicated in the pathophysiology of migraines; (2) CGRP levels are elevated in migraineurs during an attack (Bellamy et al., Headache, Vol. 46:24-33, 2006; Ashina et al., Pain, Vol. 86:133-138, 2000; Gallai et al., Cephalalgia, Vol. 15:384-390, 1995; Goadsby et al., Ann Neurol., Vol. 28:183-187, 1990; Goadsby et al., Ann Neurol., Vol. 23:193-196, 1988); (3) acute migraine therapies such as triptans restore CGRP levels to normal after treatment (Juhasz et al., Cephalalgia, Vol. 25:179-183, 2005); (4) CGRP infusion triggers the onset of migraine headaches in migraine sufferers (Petersen et al., Br J Pharmacol., Vol. 143:1074-1075, 2004; Lassen et al., Cephalalgia, Vol. 22:54-61, 2002); and (5) CGRP antagonists have demonstrated efficacy in acute migraine reversal (Connor et al., Neurology, Vol. 73:970-977, 2009; Hewitt et al., Abstract for the 14$^{th}$ Congress of the International Headache Society, 2009; LBOR3; Ho et al., Lancet, Vol. 372:2115-2123, 2008a; Ho et al., Neurology, Vol. 70:1304-1312, 2008b). Additionally, small-molecule CGRP receptor antagonists and antibody CGRP ligand antagonists have demonstrated clinical efficacy in episodic migraine prevention (Dodick et al., Lancet Neurol., Vol. 13:1100-1107, 2014a; Dodick et al., Lancet Neurol., Vol. 13:885-892 2014b; Ho et al., Neurology, Vol. 83:958-966, 2014). Taken together, these data suggest a role for the CGRP neuropeptide and its receptor in the pathogenesis of migraine.

Pituitary adenylate cyclase-activating polypeptide (PACAP) belongs to the VIP/secretin/glucagon superfamily. The sequence of PACAP 27 corresponds to the 27 N-terminal amino acids of PACAP 38 and shares 68% identity with vasoactive intestinal polypeptide (VIP) (Pantaloni et al., J. Biol. Chem., Vol. 271: 22146-22151, 1996; Pisegna and Wank, Proc. Natl. Acad. Sci. USA, Vol. 90: 6345-49, 1993; Campbell and Scanes, Growth Regul., Vol. 2:175-191, 1992). The major form of PACAP peptide in the human body is PACAP 38 and the pharmacology of PACAP 38 and PACAP 27 has not been shown to be different from each other. Three PACAP receptors have been reported: one receptor that binds PACAP with high affinity and has a much lower affinity for VIP (PAC1 receptor), and the other two receptors that recognize PACAP and VIP equally well (VPAC1 and VPAC2 receptors) (Vaudry et al., Pharmacol Rev., Vol. 61:283-357, 2009). PACAP is capable of binding all three receptors with similar potency and is thus not particularly selective. VIP, on the other hand, binds with significantly higher affinity to VPAC1 and VPAC2, as compared with PAC1. In addition to endogenous agonists PACAP and VIP, maxadilan, a 65 amino acid peptide originally isolated from the sand-fly, is exquisitely selective for PAC1 compared with VPAC1 or VPAC2.

Human experimental migraine models using PACAP as a challenge agent to induce migraine-like headaches support the role of PAC1 receptor antagonism as a potential treatment for migraine prophylaxis. Infusion of PACAP 38 causes headaches in healthy subjects and migraine-like headaches in migraine patients (Schytz et al., Brain, Vol. 132:16-25, 2009). In addition, in the same model, VIP does not cause migraine-like headaches in migraine patients (Rahmann et al., Cephalalgia, Vol. 28:226-236, 2008). The lack of migraine-like headache induction from VIP infusion suggests that PAC1 receptor, but not VPAC1 or VPAC2 receptors, is involved in migraine because VIP has a much higher affinity at the latter two receptors. These data suggest that a selective PAC1 antagonist has the potential to treat migraine.

There is a need in the art to develop migraine-specific prophylactic therapies having novel mechanisms of action that are directed to targets that underlie migraine pathophysiology. In particular, therapeutic molecules having a dual function in antagonizing both the CGRP/CGRP receptor and PACAP/PAC1 receptor pathways would be particularly beneficial.

SUMMARY OF THE INVENTION

The present invention is based, in part, on the design and generation of bispecific antigen binding proteins capable of blocking both the human CGRP receptor and the human PAC1 receptor. Such bispecific antigen binding proteins comprise a first binding domain that specifically binds to human CGRP receptor and a second binding domain that specifically binds to human PAC1 receptor. In some embodiments, each of the binding domains comprises variable regions from immunoglobulin light and heavy chains. The binding domains may be prepared from anti-CGRP receptor and anti-PAC1 receptor antibodies.

In certain embodiments, one of the binding domains is a Fab fragment and the other binding domain is a single-chain variable fragment (scFv). In other embodiments, both binding domains are Fab fragments. The bispecific antigen binding proteins may also comprise an immunoglobulin constant region or Fc region, which, in some embodiments, is derived from a human immunoglobulin IgG1 or IgG2. In certain embodiments, the constant region comprises one or more amino acid substitutions that reduce glycosylation and/or effector function of the bispecific antigen binding protein.

In some embodiments, the bispecific antigen binding proteins are monovalent for each target. In such embodiments, the bispecific antigen binding protein can be an antibody where one antigen binding domain or arm binds to the CGRP receptor and the other antigen binding domain or arm binds to the PAC1 receptor. In other embodiments, the bispecific antigen binding proteins are bivalent for each target. In such embodiments, one binding domain is positioned at the amino terminus of an immunoglobulin Fc region and the other binding domain is positioned at the carboxyl terminus of the Fc region such that, when dimerized, the antigen binding protein comprises two antigen binding domains that bind to the CGRP receptor and two antigen binding domains that bind to the PAC1 receptor.

In some embodiments, the bispecific antigen binding protein is an antibody, such as a heterodimeric antibody. The heterodimeric antibody may comprise a first light chain and a first heavy chain from a first antibody that specifically binds to human CGRP receptor and a second light chain and second heavy chain from a second antibody that specifically binds to human PAC1 receptor. In certain embodiments, the first and second heavy chains comprise one or more charge pair mutations in the constant region (e.g. CH3 domain) to promote heterodimer formation. In related embodiments, the first light chain and first heavy chain (or second light chain and second heavy chain) comprise one or more charge pair mutations to facilitate correct light-heavy chain pairing. In some such embodiments, the first heavy chain comprises an amino acid substitution introducing a charged amino acid (e.g. glutamic acid) that has the opposite charge of the amino acid introduced into the first light chain (e.g. lysine) so that the first light chain and first heavy chain are attracted to each other. The charged amino acid introduced into the second light chain (e.g. glutamic acid) would preferably have the same charge as the amino acid introduced into the first heavy chain (e.g. glutamic acid), but the opposite charge of the amino acid introduced into the second heavy chain (e.g. lysine) so that the second light chain would be attracted to the second heavy chain, but repelled from the first heavy chain.

In certain embodiments of the invention, the bispecific antigen binding protein is comprised of an antibody against a first target (e.g. CGRP receptor or PAC1 receptor) and a scFv derived from an antibody against a second target (e.g. PAC1 receptor or CGRP receptor). In this IgG-scFv format, the bispecific, multivalent antigen binding protein comprises (i) a light chain and a heavy chain from a first antibody and (ii) a scFv comprising a light chain variable region (VL) and a heavy chain variable region (VH) from a second antibody, wherein the scFv is fused at its amino terminus to the carboxyl terminus of the heavy chain optionally through a peptide linker to form a modified heavy chain, and wherein the first or second antibody specifically binds to human CGRP receptor and the other antibody specifically binds to human PAC1 receptor. In some embodiments, the scFv comprises, from N-terminus to C-terminus, a VH region, a peptide linker, and a VL region. In other embodiments, the scFv comprises, from N-terminus to C-terminus, a VL region, a peptide linker, and a VH region.

In other embodiments of the invention, the bispecific antigen binding protein is comprised of an antibody against a first target (e.g. CGRP receptor or PAC1 receptor) and a Fab fragment derived from an antibody against a second target (e.g. PAC1 receptor or CGRP receptor). In this IgG-Fab format, the bispecific, multivalent antigen binding protein comprises (i) a light chain from a first antibody, (ii) a heavy chain from the first antibody, wherein the heavy chain is fused at its carboxyl terminus optionally through a peptide linker to a first polypeptide comprising VL-CL domains or VH-CH1 domains of a second antibody to form a modified heavy chain, and (iii) a second polypeptide comprising VH-CH1 domains or VL-CL domains of the second antibody, wherein the first or second antibody specifically binds to human CGRP receptor and the other antibody specifically binds to human PAC1 receptor. In particular embodiments, the first polypeptide, which is fused to the carboxyl terminus of the heavy chain, comprises VL and CL domains (i.e. a light chain) from the second antibody, and the second polypeptide comprises VH and CH1 domains (i.e. a Fd fragment) from the second antibody. In other particular embodiments, the first polypeptide, which is fused to the carboxyl terminus of the heavy chain, comprises VH and CH1 domains (i.e. a Fd fragment) from the second antibody, and the second polypeptide comprises VL and CL domains (i.e. a light chain) from the second antibody. The CL and CH1 domains may be switched in some embodiments between the first and second polypeptide. Thus, in some embodiments, the first polypeptide, which is fused to the carboxyl terminus of the heavy chain, comprises VL and CH1 domains from the second antibody, and the second polypeptide comprises VH and CL domains from the second antibody. In other embodiments, the first polypeptide, which is fused to the carboxyl terminus of the heavy chain, comprises VH and CL domains from the second antibody, and the second polypeptide comprises VL and CH1 domains from the second antibody.

The present invention includes one or more nucleic acids encoding any of the bispecific antigen binding proteins described herein or components thereof, as well as vectors comprising the nucleic acids. Also encompassed within the invention is a recombinant host cell, such as a CHO cell, that expresses any of the bispecific antigen binding proteins.

The bispecific antigen binding proteins described herein can be used in the manufacture of a pharmaceutical composition or medicament for the treatment of conditions associated with CGRP receptor and/or PAC1 receptor, such as headache, migraine, and chronic pain. Thus, the present invention also provides a pharmaceutical composition comprising a bispecific antigen binding protein and a pharmaceutically acceptable diluent, excipient or carrier.

In some embodiments, the present invention provides a method for treating or preventing headache in a patient in need thereof comprising administering to the patient an effective amount of a bispecific antigen binding protein described herein. In some embodiments, the headache is migraine headache. The migraine can be episodic migraine or chronic migraine. In other embodiments, the headache is cluster headache. In particular embodiments, the methods provide prophylactic treatment for these conditions.

In another embodiment, the present invention provides a method for treating chronic pain in a patient in need thereof comprising administering to the patient an effective amount of a bispecific antigen binding protein described herein. The chronic pain syndromes to be treated according to the methods of the invention can include arthritic pain, such as pain associated with osteoarthritis or rheumatoid arthritis.

The use of the bispecific antigen binding proteins in any of the methods disclosed herein or for preparation of medicaments for administration according to any of the methods disclosed herein is specifically contemplated. For instance, the present invention includes a bispecific antigen binding protein for use in a method for treating or preventing a condition associated with CGRP receptor and/or PAC1 receptor in a patient in need thereof. The condition can include headache (e.g. migraine headache or cluster headache) and chronic pain.

The present invention also includes the use of a bispecific antigen binding protein in the preparation of a medicament for treating or preventing a condition associated with CGRP receptor and/or PAC1 receptor in a patient in need thereof. The condition can include headache (e.g. migraine headache or cluster headache) and chronic pain.

DETAILED DESCRIPTION

Figure 1:
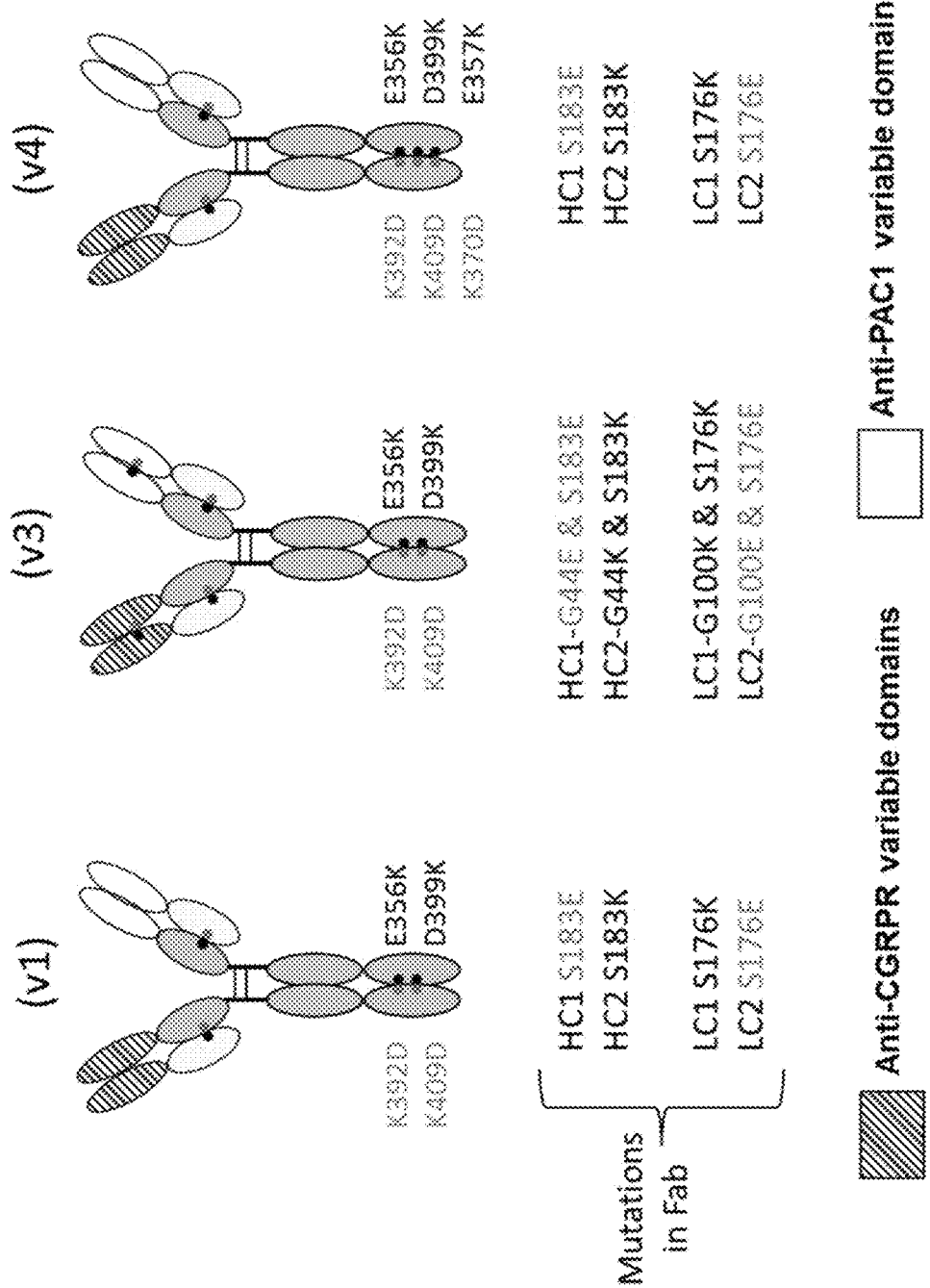
FIG. 1 shows a schematic representation of three bispecific hetero immunoglobulin formats used to generate anti-CGRP receptor/PAC1 receptor bispecific antibodies. The Kabat-EU numbering scheme is used to denote the positions of charge pair mutations within each of the chains. This IgG-like bispecific antibody format is a heterotetramer comprising two different light chains and two different heavy chains. HC1 and LC1 refer to the heavy chain and light chain, respectively, of one Fab binding arm and HC2 and LC2 refers to the heavy chain and light chain, respectively, of the second Fab binding arm. For example, in the schematic, HC1 and LC1 correspond to the anti-CGRP receptor binding arm and HC2 and LC2 correspond to the anti-PAC1 binding arm. However, the two binding arms can be switched such that HC1 and LC1 correspond to the anti-PAC1 binding arm and HC2 and LC2 correspond to the anti-CGRP receptor binding arm.

The present invention is directed to bispecific antigen binding proteins that specifically bind to both the human CGRP receptor and the human PAC1 receptor. As both CGRP receptor and PAC1 receptor signaling are implicated in the control of cerebral vascular tone, the bispecific binding proteins of the invention provide a means to simultaneously modulate both signaling cascades to ameliorate conditions associated with dysregulation of the cranial vasculature, such as cluster headache and migraine. Accordingly, in one embodiment, the present invention provides a bispecific antigen binding protein comprising a first binding domain that specifically binds to human CGRP receptor and a second binding domain that specifically binds to human PAC1 receptor.

As used herein, the term "antigen binding protein" refers to a protein that specifically binds to one or more target antigens. An antigen binding protein can include an antibody and functional fragments thereof. A "functional antibody fragment" is a portion of an antibody that lacks at least some of the amino acids present in a full-length heavy chain and/or light chain, but which is still capable of specifically binding to an antigen. A functional antibody fragment includes, but is not limited to, a single-chain variable fragment (scFv), a nanobody (e.g. VH domain of camelid heavy chain antibodies; VHH fragment, see Cortez-Retamozo et al., Cancer Research, Vol. 64:2853-57, 2004), a Fab fragment, a Fab' fragment, a F(ab')$_2$ fragment, a Fv fragment, a Fd fragment, and a complementarity determining region (CDR) fragment, and can be derived from any mammalian source, such as human, mouse, rat, rabbit, or camelid. Functional antibody fragments may compete for binding of a target antigen with an intact antibody and the fragments may be produced by the modification of intact antibodies (e.g. enzymatic or chemical cleavage) or synthesized de novo using recombinant DNA technologies or peptide synthesis.

An antigen binding protein can also include a protein comprising one or more functional antibody fragments incorporated into a single polypeptide chain or into multiple polypeptide chains. For instance, antigen binding proteins can include, but are not limited to, a diabody (see, e.g., EP 404,097; WO 93/11161; and Hollinger et al., Proc. Natl. Acad. Sci. USA, Vol. 90:6444-6448, 1993); an intrabody; a domain antibody (single VL or VH domain or two or more VH domains joined by a peptide linker; see Ward et al., Nature, Vol. 341:544-546, 1989); a maxibody (2 scFvs fused to Fc region, see Fredericks et al., Protein Engineering, Design & Selection, Vol. 17:95-106, 2004 and Powers et al., Journal of Immunological Methods, Vol. 251:123-135, 2001); a triabody; a tetrabody; a minibody (scFv fused to CH3 domain; see Olafsen et al., Protein Eng Des Sel., Vol. 17:315-23, 2004); a peptibody (one or more peptides attached to an Fc region, see WO 00/24782); a linear antibody (a pair of tandem Fd segments (VH-CH1-VH-CH1) which, together with complementary light chain polypeptides, form a pair of antigen binding regions, see Zapata et al., Protein Eng., Vol. 8:1057-1062, 1995); a small modular immunopharmaceutical (see U.S. Patent Publication No. 20030133939); and immunoglobulin fusion proteins (e.g. IgG-scFv, IgG-Fab, 2scFv-IgG, 4scFv-IgG, VH-IgG, IgG-VH, and Fab-scFv-Fc).

The antigen binding proteins of the present invention are "bispecific" meaning that they are capable of specifically binding to two different antigens, human CGRP receptor and human PAC1 receptor. As used herein, an antigen binding protein "specifically binds" to a target antigen when it has a significantly higher binding affinity for, and consequently is capable of distinguishing, that antigen, compared to its affinity for other unrelated proteins, under similar binding assay conditions. Antigen binding proteins that specifically bind an antigen may have an equilibrium dissociation constant $(K_D) \leq 1 \times 10^{-6}$ M. The antigen binding protein specifically binds antigen with "high affinity" when the $K_D$ is $\leq 1 \times 10^{-8}$ M. In one embodiment, the antigen binding proteins of the invention bind to human CGRP receptor and/or human PAC1 receptor with a $K_D$ of $\leq 5 \times 10^{-7}$ M. In another embodiment, the antigen binding proteins of the invention bind to human CGRP receptor and/or human PAC1 receptor with a $K_D$ of $\leq 1 \times 10^{-7}$ M. In yet another embodiment, the antigen binding proteins of the invention bind to human CGRP receptor and/or human PAC1 receptor with a $K_D$ of $\leq 5 \times 10^{-8}$ M. In another embodiment, the antigen binding proteins of the invention bind to human CGRP receptor and/or human PAC1 receptor with a $K_D$ of $\leq 1 \times 10^{-8}$ M. In certain embodiments, the antigen binding proteins of the invention bind to human CGRP receptor and/or human PAC1 receptor with a $K_D$ of $\leq 5 \times 10^{-9}$ M. In other embodiments, the antigen binding proteins of the invention bind to human CGRP receptor and/or human PAC1 receptor with a $K_D$ of $\leq 1 \times 10^{-9}$ M. In one particular embodiment, the antigen binding proteins of the invention bind to human CGRP receptor and/or human PAC1 receptor with a $K_D$ of $\leq 5 \times 10^{-10}$ M. In another particular embodiment, the antigen binding proteins of the invention bind to human CGRP receptor and/or human PAC1 receptor with a $K_D$ of $\leq 1 \times 10^{-10}$ M.

Affinity is determined using a variety of techniques, an example of which is an affinity ELISA assay. In various embodiments, affinity is determined by a surface plasmon resonance assay (e.g., BIAcore®-based assay). Using this methodology, the association rate constant ($k_a$ in M$^{-1}$s$^{-1}$) and the dissociation rate constant ($k_d$ in s$^1$) can be measured. The equilibrium dissociation constant ($K_D$ in M) can then be calculated from the ratio of the kinetic rate constants ($k_d/k_a$). In some embodiments, affinity is determined by a kinetic method, such as a Kinetic Exclusion Assay (KinExA) as described in Rathanaswami et al. Analytical Biochemistry, Vol. 373:52-60, 2008. Using a KinExA assay, the equilibrium dissociation constant ($K_D$ in M) and the association rate constant ($k_a$ in M$^{-1}$s$^{-1}$) can be measured. The dissociation rate constant ($k_d$ in s$^{-1}$) can be calculated from these values ($K_D \times k_a$). In other embodiments, affinity is determined by an equilibrium/solution method. In certain embodiments, affinity is determined by a FACS binding assay. WO 2010/075238 and WO 2014/144632, both of which are hereby incorporated by reference in their entireties, describe suitable affinity assays for determining the affinity of a binding protein for human CGRP receptor and human PAC1 receptor. In certain embodiments of the invention, the antigen binding protein specifically binds to human CGRP receptor and/or human PAC1 receptor expressed by a mammalian cell (e.g., CHO, HEK 293, Jurkat), with a $K_D$ of 20 nM ($2.0 \times 10^{-8}$ M) or less, $K_D$ of 10 nM ($1.0 \times 10^{-8}$ M) or less, $K_D$ of 1 nM ($1.0 \times 10^{-9}$ M) or less, $K_D$ of 500 pM ($5.0 \times 10^{-10}$ M) or less, $K_D$ of 200 pM ($2.0 \times 10^{-10}$ M) or less, $K_D$ of 150 pM ($1.50 \times 10^{-10}$ M) or less, $K_D$ of 125 pM ($1.25 \times 10^{-10}$ M) or less, $K_D$ of 105 pM ($1.05 \times 10^{-10}$ M) or less, $K_D$ of 50 pM ($5.0 \times 10^{11}$ M) or less, or $K_D$ of 20 pM ($2.0 \times 10^{11}$ M) or less, as determined by a Kinetic Exclusion Assay, conducted by the method described in Rathanaswami et al. Analytical Biochemistry, Vol. 373:52-60, 2008. In some embodiments, the bispecific antigen binding proteins described herein exhibit desirable characteristics such as binding avidity as measured by $k_d$ (dissociation rate constant) for human CGRP receptor or human PAC1 receptor of about $10^{-2}$, $10^{-3}$, $10^{-4}$, $10^{-5}$, $10^{-6}$, $10^{-7}$, $10^{-8}$, $10^{-9}$, $10^{-10}$ s$^{-1}$ or lower (lower values indicating higher binding avidity), and/or binding affinity as measured by $K_D$ (equilibrium dissociation constant) for human CGRP receptor or human PAC1 of about $10^{-9}$, 10-10, $10^{11}$, $10^{-12}$, $10^{-13}$, $10^{-14}$, $10^{-15}$, $10^{-16}$ M or lower (lower values indicating higher binding affinity).

In some embodiments of the invention, the antigen binding proteins are multivalent. The valency of the binding protein denotes the number of individual antigen binding domains within the binding protein. For example, the terms "monovalent," "bivalent," and "tetravalent" with reference to the antigen binding proteins of the invention refer to binding proteins with one, two, and four antigen binding domains, respectively. Thus, a multivalent antigen binding protein comprises two or more antigen binding domains. In some embodiments, the bispecific antigen binding proteins of the invention are bivalent. Thus, such bispecific, bivalent antigen binding proteins contain two antigen binding domains: one antigen-binding domain binding to human CGRP receptor and one antigen-binding domain binding to human PAC1 receptor. In other embodiments, the bispecific antigen binding proteins are multivalent. For instance, in certain embodiments, the bispecific antigen binding proteins are tetravalent comprising four antigen-binding domains: two antigen-binding domains binding to human CGRP receptor and two antigen-binding domains binding to human PAC1 receptor.

As used herein, the term "antigen binding domain," which is used interchangeably with "binding domain," refers to the region of the antigen binding protein that contains the amino acid residues that interact with the antigen and confer on the antigen binding protein its specificity and affinity for the antigen. In some embodiments, the binding domain may be derived from the natural ligands of the human CGRP receptor and the human PAC1 receptor. For example, the binding domain that specifically binds to human CGRP receptor may be derived from human α-CGRP and comprise peptide antagonists, such as the CGRP8-37 antagonist peptide and variants thereof described in Chiba et al., Am. J. Physiol., Vol. 256: E331-E335, 1989 and Taylor et al., J. Pharmacol. Exp. Ther., Vol. 319: 749-757, 2006. Similarly, the binding domain that specifically binds to human PAC1 receptor may be derived from PACAP38 or PACAP27 and may comprise peptide antagonists such as those described in Bourgault et al., J. Med. Chem., Vol. 52: 3308-3316, 2009 and U.S. Pat. No. 6,017,533.

In certain embodiments of the bispecific antigen binding proteins of the invention, the binding domain may be derived from an antibody or functional fragment thereof. For instance, the binding domains of the bispecific antigen binding proteins of the invention may comprise one or more complementarity determining regions (CDR) from the light and heavy chain variable regions of antibodies that specifically bind to human CGRP receptor or human PAC1 receptor. As used herein, the term "CDR" refers to the complementarity determining region (also termed "minimal recognition units" or "hypervariable region") within antibody variable sequences. There are three heavy chain variable region CDRs (CDRH1, CDRH2 and CDRH3) and three light chain variable region CDRs (CDRL1, CDRL2 and CDRL3). The term "CDR region" as used herein refers to a group of three CDRs that occur in a single variable region (i.e. the three light chain CDRs or the three heavy chain CDRs). The CDRs in each of the two chains typically are aligned by the framework regions to form a structure that binds specifically with a specific epitope or domain on the target protein (e.g., human CGRP receptor or human PAC1 receptor). From N-terminus to C-terminus, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342:878-883.

Complementarity determining regions (CDRs) and framework regions (FR) of a given antibody may be identified using this system. In some embodiments, the anti-CGRP receptor binding domain of the bispecific antigen binding proteins of the invention comprise all six CDRs of the heavy and light chain variable regions of an anti-CGRP receptor antibody and the anti-PAC1 receptor binding domain of the bispecific antigen binding proteins of the invention comprise all six CDRs of the heavy and light chain variable regions of an anti-PAC1 receptor antibody.

In some embodiments of the bispecific antigen binding proteins of the invention, the binding domains (the anti-CGRP receptor binding domain, the anti-PAC1 receptor binding domain or both) comprise a Fab, a Fab', a F(ab')$_2$, a Fv, a single-chain variable fragment (scFv), or a nanobody. In one embodiment, both binding domains are Fab fragments. In another embodiment, one binding domain is a Fab fragment and the other binding domain is a scFv.

Papain digestion of antibodies produces two identical antigen-binding fragments, called "Fab" fragments, each with a single antigen-binding site, and a residual "Fc" fragment which contains the immunoglobulin constant region. The Fab fragment contains all of the variable domain, as well as the constant domain of the light chain and the first constant domain (CH1) of the heavy chain. Thus, a "Fab fragment" is comprised of one immunoglobulin light chain (light chain variable region (VL) and constant region (CL)) and the CH1 region and variable region (VH) of one immunoglobulin heavy chain. The heavy chain of a Fab molecule cannot form a disulfide bond with another heavy chain molecule. The Fc fragment displays carbohydrates and is responsible for many antibody effector functions (such as binding complement and cell receptors), that distinguish one class of antibody from another. The "Fd fragment" comprises the VH and CH1 domains from an immunoglobulin heavy chain. The Fd fragment represents the heavy chain component of the Fab fragment.

A "Fab' fragment" is a Fab fragment having at the C-terminus of the CH1 domain one or more cysteine residues from the antibody hinge region.

A "F(ab')$_2$ fragment" is a bivalent fragment including two Fab' fragments linked by a disulfide bridge between the heavy chains at the hinge region.

The "Fv" fragment is the minimum fragment that contains a complete antigen recognition and binding site from an antibody. This fragment consists of a dimer of one immunoglobulin heavy chain variable region (VH) and one immunoglobulin light chain variable region (VL) in tight, non-covalent association. It is in this configuration that the three CDRs of each variable region interact to define an antigen binding site on the surface of the VH-VL dimer. A single light chain or heavy chain variable region (or half of an Fv fragment comprising only three CDRs specific for an antigen) has the ability to recognize and bind antigen, although at a lower affinity than the entire binding site comprising both VH and VL.

A "single-chain variable antibody fragment" or "scFv fragment" comprises the VH and VL regions of an antibody, wherein these regions are present in a single polypeptide chain, and optionally comprising a peptide linker between the VH and VL regions that enables the Fv to form the desired structure for antigen binding (see e.g., Bird et al., Science, Vol. 242:423-426, 1988; and Huston et al., Proc. Natl. Acad. Sci. USA, Vol. 85:5879-5883, 1988).

A "nanobody" is the heavy chain variable region of a heavy-chain antibody. Such variable domains are the smallest fully functional antigen-binding fragment of such heavy-chain antibodies with a molecular mass of only 15 kDa. See Cortez-Retamozo et al., *Cancer Research* 64:2853-57, 2004. Functional heavy-chain antibodies devoid of light chains are naturally occurring in certain species of animals, such as nurse sharks, wobbegong sharks and Camelidae, such as camels, dromedaries, alpacas and llamas. The antigen-binding site is reduced to a single domain, the VHH domain, in these animals. These antibodies form antigen-binding regions using only heavy chain variable region, i.e., these functional antibodies are homodimers of heavy chains only having the structure $H_2L_2$ (referred to as "heavy-chain antibodies" or "HCAbs"). Camelized VHH reportedly recombines with IgG2 and IgG3 constant regions that contain hinge, CH2, and CH3 domains and lack a CH1 domain. Camelized VHH domains have been found to bind to antigen with high affinity (Desmyter et al., J. Biol. Chem., Vol. 276:26285-90, 2001) and possess high stability in solution (Ewert et al., Biochemistry, Vol. 41:3628-36, 2002). Methods for generating antibodies having camelized heavy chains are described in, for example, U.S. Patent Publication Nos. 2005/0136049 and 2005/0037421. Alternative scaffolds can be made from human variable-like domains that more closely match the shark V-NAR scaffold and may provide a framework for a long penetrating loop structure.

In particular embodiments of the bispecific antigen binding proteins of the invention, the binding domains comprise an immunoglobulin heavy chain variable region (VH) and an immunoglobulin light chain variable region (VL) of an antibody or antibody fragment which specifically binds to the desired antigen. For instance, the anti-CGRP receptor binding domain of the bispecific antigen binding proteins of the invention comprises a VH region and VL region from an anti-CGRP receptor antibody and the anti-PAC1 receptor binding domain comprises a VH region and VL region from an anti-PAC1 receptor antibody.

The "variable region," used interchangeably herein with "variable domain" (variable region of a light chain (VL), variable region of a heavy chain (VH)) refers to the region in each of the light and heavy immunoglobulin chains which is involved directly in binding the antibody to the antigen. As discussed above, the regions of variable light and heavy chains have the same general structure and each region comprises four framework (FR) regions whose sequences are widely conserved, connected by three CDRs. The framework regions adopt a beta-sheet conformation and the CDRs may form loops connecting the beta-sheet structure. The CDRs in each chain are held in their three-dimensional structure by the framework regions and form, together with the CDRs from the other chain, the antigen binding site.

The binding domains that specifically bind to human CGRP receptor or human PAC1 receptor can be derived a) from known antibodies to these antigens or b) from new antibodies or antibody fragments obtained by de novo immunization methods using the antigen proteins or fragments thereof, by phage display, or other routine methods. The antibodies from which the binding domains for the bispecific antigen binding proteins are derived can be monoclonal antibodies, polyclonal antibodies, recombinant antibodies, human antibodies, or humanized antibodies. In certain embodiments, the antibodies from which the binding domains are derived are monoclonal antibodies. In these and other embodiments, the antibodies are human antibodies or humanized antibodies and can be of the IgG1-, IgG2-, IgG3-, or IgG4-type.

The term "monoclonal antibody" (or "mAb") as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against an individual antigenic site or epitope, in contrast to polyclonal antibody preparations that typically include different antibodies directed against different epitopes. Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas).

Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a CGRP receptor or PAC1 receptor immunogen; harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds CGRP receptor or PAC1 receptor.

Monoclonal antibodies secreted by a hybridoma cell line can be purified using any technique known in the art, such as protein A-Sepharose, hydroxylapatite chromatography, gel electrophoresis, dialysis, or affinity chromatography. Hybridomas or mAbs may be further screened to identify mAbs with particular properties, such as the ability to bind cells expressing CGRP receptor or PAC1 receptor, ability to block or interfere with the binding of the CGRP ligand or PACAP ligand to their respective receptors, or the ability to functionally block either of the receptors, e.g., using a cAMP assay, e.g., as described herein.

In some embodiments, the anti-PAC1 receptor and anti-CGRP receptor binding domains of the bispecific antigen binding proteins of the invention may be derived from humanized antibodies against the PAC1 receptor and CGRP receptor, respectively. A "humanized antibody" refers to an antibody in which regions (e.g. framework regions) have been modified to comprise corresponding regions from a human immunoglobulin. Generally, a humanized antibody can be produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. Nos. 5,585,089 and 5,693,762; Jones et al., Nature, Vol. 321:522-525, 1986; Riechmann et al., Nature, Vol. 332:323-27, 1988; Verhoeyen et al., Science, Vol. 239:1534-1536, 1988). The CDRs of light and heavy chain variable regions of antibodies generated in another species can be grafted to consensus human FRs. To create consensus human FRs, FRs from several human heavy chain or light chain amino acid sequences may be aligned to identify a consensus amino acid sequence.

New antibodies generated against the human CGRP receptor or the human PAC1 receptor from which binding domains for the bispecific antigen binding proteins of the invention can be derived can be fully human antibodies. A "fully human antibody" is an antibody that comprises variable and constant regions derived from or indicative of human germ line immunoglobulin sequences. One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, Proc. Natl. Acad. Sci. USA 90:2551-2555; Jakobovits et al., 1993, Nature 362:255-258; and Bruggermann et al., 1993, Year in Immunol. 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/33735 and WO94/02602. Additional methods relating to transgenic mice for making human antibodies are described in U.S. Pat. Nos. 5,545,807; 6,713,610; 6,673,986; 6,162,963; 5,939,598; 5,545,807; 6,300,129; 6,255,458; 5,877,397; 5,874,299 and 5,545,806; in PCT publications WO91/10741, WO90/04036, WO 94/02602, WO 96/30498, WO 98/24893 and in EP 546073B1 and EP 546073A1.

The transgenic mice described above, referred to herein as "HuMab" mice, contain a human immunoglobulin gene minilocus that encodes unrearranged human heavy (mu and gamma) and kappa light chain immunoglobulin sequences, together with targeted mutations that inactivate the endogenous mu and kappa chain loci (Lonberg et al., 1994, Nature 368:856-859). Accordingly, the mice exhibit reduced expression of mouse IgM or kappa and in response to immunization, and the introduced human heavy and light chain transgenes undergo class switching and somatic mutation to generate high affinity human IgG kappa monoclonal antibodies (Lonberg et al., supra.; Lonberg and Huszar, 1995, Intern. Rev. Immunol. 13: 65-93; Harding and Lonberg, 1995, Ann. N.Y Acad. Sci. 764:536-546). The preparation of HuMab mice is described in detail in Taylor et al., 1992, Nucleic Acids Research 20:6287-6295; Chen et al., 1993, International Immunology 5:647-656; Tuaillon et al., 1994, J. Immunol. 152:2912-2920; Lonberg et al., 1994, Nature 368:856-859; Lonberg, 1994, Handbook of Exp. Pharmacology 113:49-101; Taylor et al., 1994, International Immunology 6:579-591; Lonberg and Huszar, 1995, Intern. Rev. Immunol. 13:65-93; Harding and Lonberg, 1995, Ann. N.Y Acad. Sci. 764:536-546; Fishwild et al., 1996, Nature Biotechnology 14:845-851; the foregoing references are hereby incorporated by reference in their entirety for all purposes. See, further U.S. Pat. Nos. 5,545,806; 5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227; WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., 1997, Nature Genetics 15:146-156, which are hereby incorporated by reference. For example, the HCo7 and HCo12 transgenic mice strains can be used to generate additional fully human anti-CGRP receptor and anti-PAC1 receptor antibodies.

Human-derived antibodies can also be generated using phage display techniques. Phage display is described in e.g., Dower et al., WO 91/17271, McCafferty et al., WO 92/01047, and Caton and Koprowski, Proc. Natl. Acad. Sci. USA, 87:6450-6454 (1990), each of which is incorporated herein by reference in its entirety. The antibodies produced by phage technology are usually produced as antigen binding fragments, e.g. Fv or Fab fragments, in bacteria and thus lack effector functions. Effector functions can be introduced by one of two strategies: The fragments can be engineered either into complete antibodies for expression in mammalian cells, or into bispecific antibody fragments with a second binding site capable of triggering an effector function, if desired. Typically, the Fd fragment (VH-CH1) and light chain (VL-CL) of antibodies are separately cloned by PCR and recombined randomly in combinatorial phage display libraries, which can then be selected for binding to a particular antigen. The antibody fragments are expressed on the phage surface, and selection of Fv or Fab (and therefore the phage containing the DNA encoding the antibody fragment) by antigen binding is accomplished through several rounds of antigen binding and re-amplification, a procedure termed panning. Antibody fragments specific for the antigen are enriched and finally isolated. Phage display techniques can also be used in an approach for the humanization of rodent monoclonal antibodies, called "guided selection" (see Jespers, L. S., et al., Bio/Technology 12, 899-903 (1994)). For this, the Fd fragment of the mouse monoclonal antibody can be displayed in combination with a human light chain library, and the resulting hybrid Fab library may then be selected with antigen. The mouse Fd fragment thereby provides a template to guide the selection. Subsequently, the selected human light chains are combined with a human Fd fragment library. Selection of the resulting library yields entirely human Fab.

The bispecific antigen binding proteins of the invention comprise a binding domain that specifically binds to the human PAC1 receptor. The human PAC1 receptor (also referred to herein as "human PAC1," "hPAC1," and "hPAC1 receptor") is a 468 amino acid protein designated as P41586 (PACR_HUMAN) in the UniProtKB/Swiss-Prot database and is encoded by the ADCYAP1R1 gene. PACAP-27 and PACAP-38 are the principal endogenous agonists of PAC1. The amino acid sequence of the human PAC1 receptor is set forth below:

```
                                          (SEQ ID NO: 339)
MAGVVHVSLA  ALLLLPMAPA  MHSDCIFKKE  QAMCLEKIQR

ANELMGFNDS  SPGCPGMWDN  ITCWKPAHVG  EMVLVSCPEL

FRIFNPDQVW  ETETIGESDF  GDSNSLDLSD  MGVVSRNCTE

DGWSEPFPHY  FDACGFDEYE  SETGDQDYYY  LSVKALYTVG

YSTSLVTLTT  AMVILCRFRK  LHCTRNFIHM  NLFVSFMLRA

ISVFIKDWIL  YAEQDSNHCF  ISTVECKAVM  VFFHYCVVSN

YFWLFIEGLY  LFTLLVETFF  PERRYFYWYT  IIGWGTPTVC

VTVWATLRLY  FDDTGCWDMN  DSTALWWVIK  GPVVGSIMVN

FVLFIGIIVI  LVQKLQSPDM  GGNESSIYLR  LARSTLLLIP

LFGIHYTVFA  FSPENVSKRE  RLVFELGLGS  FQGFVVAVLY

CFLNGEVQAE  IKRKWRSWKV  NRYFAVDFKH  RHPSLASSGV

NGGTQLSILS  KSSSQIRMSG  LPADNLAT
```

In certain embodiments, the anti-PAC1 binding domain of the bispecific antigen binding proteins of the invention comprises the VH region and/or the VL region or CDR regions from an anti-PAC1 receptor antibody or functional fragment thereof. Preferably, the anti-PAC1 receptor antibody or functional fragment thereof specifically binds to human PAC1 receptor and prevents or reduces binding of the receptor to PACAP-38 and/or PACAP-27. In some embodiments, the anti-PAC1 receptor antibody or functional fragment thereof specifically binds to an extracellular region of the human PAC1 receptor. In one particular embodiment, the anti-PAC1 receptor antibody or functional fragment thereof specifically binds to the amino-terminal extracellular domain of the PAC1 receptor (i.e. amino acids 21-155 of SEQ ID NO: 339).

In some embodiments, the anti-PAC1 antibody or functional fragment thereof from which the anti-PAC1 binding domain of the bispecific antigen binding proteins of the invention is derived selectively inhibits the human PAC1 receptor relative to the human VPAC1 and human VPAC2 receptors. An antibody or functional fragment thereof "selectively inhibits" a specific receptor relative to other receptors when the IC50 of the antibody in an inhibition assay of the specific receptor is at least 50-fold lower than the IC50 in an inhibition assay of another "reference" receptor, e.g., a hVPAC1 or hVPAC2 receptor. An "IC50" is the dose/concentration required to achieve 50% inhibition of a biological or biochemical function. With radioactive ligands, IC50 is the concentration of a competing ligand that displaces 50% of the specific binding of the radioligand. The IC50 of any particular substance or antagonist can be determined by constructing a dose-response curve and examining the effect of different concentrations of the drug or antagonist on reversing agonist activity in a particular functional assay. IC50 values can be calculated for a given antagonist or drug by determining the concentration needed to inhibit half of the maximum biological response of the agonist. Thus, the IC50 value for any anti-PAC1 antibody or functional fragment thereof can be calculated by determining the concentration of the antibody or fragment needed to inhibit half of the maximum biological response of the PACAP ligand (PACAP-27 or PACAP-3.8) in activating the human PAC1 receptor in any functional assay, such as the cAMP assay described in the Examples. An antibody or functional fragment thereof that selectively inhibits a specific receptor is understood to be a neutralizing antibody or neutralizing fragment with respect to that receptor. Thus, in some embodiments, the anti-PAC1 receptor antibody or functional fragment thereof from which the anti-PAC1 binding domain of the bispecific antigen binding proteins of the invention is derived is a neutralizing antibody or fragment of the human PAC1 receptor.

The variable regions or CDR regions of any anti-PAC1 receptor antibody or functional fragment thereof can be used to construct the anti-PAC1 binding domain of any of the bispecific antigen binding proteins described herein. For instance, the anti-PAC1 binding domain of the bispecific antigen binding proteins of the invention may comprise VH and/or VL regions or one or more CDRs from any of the anti-human PAC1 receptor antibodies described in WO 2014/144632, which is hereby incorporated by reference in its entirety. In certain embodiments, the anti-PAC1 antibody from which the anti-PAC1 binding domain is derived competes for binding of the human PAC1 receptor with one or more of the human anti-PAC1 antibodies described in WO 2014/144632 or one or more of the anti-PAC1 antibodies described below. The term "compete" refers to the ability of an antibody or other antigen binding protein to interfere with the binding of other antibodies or binding fragments to a target (e.g. the human PAC1 receptor or the human CGRP receptor). The extent to which an antibody or binding fragment is able to interfere with the binding of another antibody or binding fragment to a target (e.g. the human PAC1 receptor or the human CGRP receptor), and therefore whether it can be said to compete, can be determined using competition binding assays. Numerous types of competitive binding assays can be used, including for example: solid phase direct or indirect radioimmunoassay (RIA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol.

137:3614-3619); solid phase direct-labeled assay, solid phase direct-labeled sandwich assay (see, e.g., Harlow and Lane, 1988, Antibodies, A Laboratory Manual, Cold Spring Harbor Press); solid phase direct label RIA using I-125 label (see, e.g., Morel et al., 1988, Molec. Immunol. 25:7-15); solid phase direct biotin-avidin EIA (see, e.g., Cheung, et al., 1990, Virology 176:546-552); and direct labeled RIA (Moldenhauer et al., 1990, Scand. J. Immunol. 32:77-82). Typically, a competitive binding assay involves the use of purified antigen bound to a solid surface or cells bearing the antigen, an unlabeled test antibody or other antigen binding protein, and a labeled reference antibody or other antigen binding protein. Competitive inhibition is measured by determining the amount of label bound to the solid surface or cells in the presence of the test antibody or other antigen binding protein. Usually the test antibody or other antigen binding protein is present in excess. Antibodies or other antigen binding proteins identified by competition assay (i.e. competing antibodies and antigen binding proteins) include antibodies and antigen binding proteins binding to the same epitope as the reference antibody or antigen binding protein.

Usually, when a competing antibody or other antigen binding protein is present in excess, it will inhibit specific binding of a reference antibody or other antigen binding protein to a target antigen by at least 40%, 45%, 50%, 55%, 60%, 65%, 70% or 75%. In some instances, binding of the reference antibody or other antigen binding protein is inhibited by at least 80%, 85%, 90%, 95%, or 97% or more. In some embodiments, a competing antibody or binding fragment thereof reduces human PAC1 receptor binding of a reference antibody between about 40% and 100%, such as about 60% and about 100%, specifically between about 70% and 100%, and more specifically between about 80% and 100%.

A particularly suitable quantitative assay for detecting competitive binding uses a Biacore machine which measures the extent of interactions using surface plasmon resonance technology.

An exemplary Biacore-based competitive binding assay involves the immobilization of a reference antibody to a sensor chip. The target antigen is then contacted with the sensor chip where the target antigen is captured by the immobilized reference antibody. Test antibodies are then injected over the captured target antigen. If the injected test antibody recognizes a distinct epitope from that recognized by the immobilized antibody, then a second binding event is observed and the test antibody would be considered not to compete for binding to the target antigen with the reference antibody. Another suitable quantitative competition binding assay uses a FACS-based approach to measure competition between antibodies in terms of their binding to the human PAC1 receptor.

Light chain and heavy chain variable regions and associated CDRs of exemplary human anti-PAC1 receptor antibodies from which the anti-PAC1 binding domain of the bispecific antigen binding proteins of the invention can be derived or constructed are set forth below in Tables 1A and 1B, respectively.

TABLE 1A

Exemplary Anti-PAC1 Receptor Light Chain Variable Region Amino Acid Sequences

| Antibody ID. | VL Group | VL Amino Acid Sequence | CDRL1 | CDRL2 | CDRL3 |
|---|---|---|---|---|---|
| 01A, 01C, 01D | LV-01 | DIQMTQSPSSLSASVGDRITITCRARASQSISRYLN SQSISRYLNWYQQKPGKAPKLLIY AASSLQSGIPSRFSGSGSGTDFTLT INSLQPEDFATYFCQQSYSPPFTFG PGTKVDIKR (SEQ ID NO: 28) | SQSISRYLN (SEQ ID NO: 1) | AASSLQS (SEQ ID NO: 14) | QQSYSPPFT (SEQ ID NO: 20) |
| 01B | LV-02 | DIQMTQSPSSLSASVGDRITITCRARASQSISRYLN SQSISRYLNWYQQKPGKAPKLLIY AASSLQSGIPSRFSGSGSGTDFTLT INSLQPEDFATYFCQQSYSPPFTFG EGTKVDIKR (SEQ ID NO: 29) | SQSISRYLN (SEQ ID NO: 1) | AASSLQS (SEQ ID NO: 14) | QQSYSPPFT (SEQ ID NO: 20) |
| 02A, 02C | LV-03 | DIQMTQSPSSLSASVGDRITITCRARASQSISRYLN SQSISRYLNWYQQKPGKAPKLLIY AASSLQSGIPSRFSGSGSGTDFTLT INSLQPEDFATYFCQQSYSPPFTFG QGTKVDIKR (SEQ ID NO: 30) | SQSISRYLN (SEQ ID NO: 1) | AASSLQS (SEQ ID NO: 14) | QQSYSPPFT (SEQ ID NO: 20) |
| 03A, 03C, 03D | LV-04 | DIQLTQSPSFLSASVGDRVTITCRARASQSIGRSLH SQSIGRSLHWYQQKPGKAPKLLIK YASQSLSGVPSRFSGSGSGTEFTL TISSLQPEDFATYYCHQSSRLPFTF GPGTKVDIKR (SEQ ID NO: 31) | SQSIGRSLH (SEQ ID NO: 2) | YASQSLS (SEQ ID NO: 15) | HQSSRLPFT (SEQ ID NO: 21) |
| 03B | LV-05 | DIQLTQSPSFLSASVGDRVTITCRARASQSIGRSLH SQSIGRSLHWYQQKPGKAPKLLIK YASQSLSGVPSRFSGSGSGTEFTL TISSLQPEDFATYYCHQSSRLPFTF GEGTKVDIKR (SEQ ID NO: 32) | SQSIGRSLH (SEQ ID NO: 2) | YASQSLS (SEQ ID NO: 15) | HQSSRLPFT (SEQ ID NO: 21) |
| 04A, 04C, 04D | LV-06 | EIVLTQSPATLSLSPGERATLSCRARASQSVGRSLH SQSVGRSLHWYQQKPGQAPRLLI (SEQ ID | | YASQSLS (SEQ ID | HQSSRLPFT (SEQ ID |

TABLE 1A-continued

Exemplary Anti-PAC1 Receptor Light Chain Variable Region Amino Acid Sequences

| Antibody ID. | VL Group | VL Amino Acid Sequence | CDRL1 | CDRL2 | CDRL3 |
|---|---|---|---|---|---|
| | | KYASQSLSGIPARFSGSGSGTDFT LTISSLEPEDFAVYYCHQSSRLPFT FGPGTKVDIKR (SEQ ID NO: 33) | NO: 3) | NO: 15) | NO: 21) |
| 04B | LV-07 | EIVLTQSPATLSLSPGERATLSCRARASQSVGRSLH SQSVGRSLHWYQQKPGQAPRLLI KYASQSLSGIPARFSGSGSGTDFT LTISSLEPEDFAVYYCHQSSRLPFT FGEGTKVDIKR (SEQ ID NO: 34) | YASQSLS (SEQ ID NO: 3) | HQSSRLPFT (SEQ ID NO: 15) | (SEQ ID NO: 21) |
| 05A, 05C, 05D | LV-08 | DIVMTQSPDSLAVSLGERATIHCK SSQSVLYSSNNKNFLTWYQQKPG QPPKLLIYRASTRESGVPDRFSGS GSGTDFTLTISSLQAEDVAVYFCQ QYYSAPFTFGPGTRVDIKR (SEQ ID NO: 35) | KSSQSVLYSSN NKNFLT (SEQ ID NO: 4) | RASTRES (SEQ ID NO: 16) | QQYYSAPF T (SEQ ID NO: 22) |
| 05B | LV-09 | DIVMTQSPDSLAVSLGERATIHCK SSQSVLYSSNNKNFLTWYQQKPG QPPKLLIYRASTRESGVPDRFSGS GSGTDFTLTISSLQAEDVAVYFCQ QYYSAPFTFGEGTRVDIKR (SEQ ID NO: 36) | KSSQSVLYSSN NKNFLT (SEQ ID NO: 4) | RASTRES (SEQ ID NO: 16) | QQYYSAPF T (SEQ ID NO: 22) |
| 06A, 06C | LV-10 | DIVMTQSPDSLAVSLGERATINCK SSQSVLYSSNNKNFLTWYQQKPG QPPKLLIYRASTRESGVPDRFSGS GSGTDFTLTISSLQAEDVAVYFCQ QYYSAPFTFGPGTRVDIKR (SEQ ID NO: 37) | KSSQSVLYSSN NKNFLT (SEQ ID NO: 4) | RASTRES (SEQ ID NO: 16) | QQYYSAPF T (SEQ ID NO: 22) |
| 06B | LV-11 | DIVMTQSPDSLAVSLGERATINCK SSQSVLYSSNNKNFLTWYQQKPG QPPKLLIYRASTRESGVPDRFSGS GSGTDFTLTISSLQAEDVAVYFCQ QYYSAPFTFGEGTRVDIKR (SEQ ID NO: 38) | KSSQSVLYSSN NKNFLT (SEQ ID NO: 4) | RASTRES (SEQ ID NO: 16) | QQYYSAPF T (SEQ ID NO: 22) |
| 07 | LV-12 | EIVLTQSPDFQSVTPKEKVTITCRARASQSIGSSLH SQSIGSSLHWYQQKPDQSPKLLIK YASQSLSGIPSRFSGSGSGTHFTLT INSLEAEDAATYYCHQSSRLPFTF GPGTKVDIKR (SEQ ID NO: 39) | YASQSLS (SEQ ID NO: 5) | HQSSRLPFT (SEQ ID NO: 15) | (SEQ ID NO: 21) |
| 08, 09, 10 | LV-13 | EIVLTQSPDFQSVTPKEKVTITCRARASQSVGRSLH SQSVGRSLHWYQHKPDQSPKLLI KYASQSLSGVPSRFSGSGSGTDFT LIINSLEAEDAATYYCHQSSRLPFT FGPGTKVDIKR (SEQ ID NO: 40) | YASQSLS (SEQ ID NO: 3) | HQSSRLPFT (SEQ ID NO: 15) | (SEQ ID NO: 21) |
| 11 | LV-14 | DIQLTQSPSFLSASVGDRVTITCRARASQSIGRSLH SQSIGRSLHWYHQKPGKAPKLLIK YASQSLSGVPSRFSGSGSGTEFTLT ISSLQPEDFATYYCHQSSRLPFTFG PGTKVDIKR (SEQ ID NO: 41) | YASQSLS (SEQ ID NO: 2) | HQSSRLPFT (SEQ ID NO: 15) | (SEQ ID NO: 21) |
| 12, 13, 14 | LV-15 | EIVLTQSPDFQSVTPKEKVTITCRARASQSVGRSLH SQSVGRSLHWYQQKPDQSPKLLI KYASQSLSGVPSRFSGSGSGTDFT LTINSLEAEDAATYYCHQSSRLPF TFGPGTKVDIKR (SEQ ID NO: 42) | YASQSLS (SEQ ID NO: 3) | HQSSRLPFT (SEQ ID NO: 15) | (SEQ ID NO: 21) |
| 15, 16, 17, 18 | LV-16 | EIVLTQSPGTLSLSPGERATLSCRARASQSVGRSLH SQSVGRSLHWYQQKPGQAPRLLI KYASQSLSGIPDRFSGSGSGTDFT LTISRLEPEDFATYYCHQSSRLPFT FGQGTKVEIKR (SEQ ID NO: 43) | YASQSLS (SEQ ID NO: 3) | HQSSRLPFT (SEQ ID NO: 15) | (SEQ ID NO: 21) |

TABLE 1A-continued

Exemplary Anti-PAC1 Receptor Light Chain Variable Region Amino Acid Sequences

| Antibody ID. | VL Group | VL Amino Acid Sequence | CDRL1 | CDRL2 | CDRL3 |
|---|---|---|---|---|---|
| 19 | LV-17 | EIVLTQSPDFQSVTPKEKVTITCRARASQSIGRSLHWYQQKPDQSPKLLFKYASQSLSGVPSRFSGSGSGTDFTLTINSLEAEDAATYYCHQSSRLPFTFGPGTKVDIKR (SEQ ID NO: 44) | RASQSIGRSLH (SEQ ID NO: 2) | YASQSLS (SEQ ID NO: 15) | HQSSRLPFT (SEQ ID NO: 21) |
| 20 | LV-18 | DIQLTQSPSFLSASVGDRVTITCRARASQSIGRSLHWYQQKPGKAPKLLFKYASQSLSGVPSRFSGSGSGIEFTLTISSLQPEDFATYYCHQSSRLPFTFGPGTKVDIKR (SEQ ID NO: 45) | RASQSIGRSLH (SEQ ID NO: 2) | YASQSLS (SEQ ID NO: 15) | HQSSRLPFT (SEQ ID NO: 21) |
| 21 | LV-19 | EIVLTQSPGTLSLSPGERATLSCRARASQSVSSSYLSQSVSSSYLAWYQQKPGQAPRLLIYGASSRATGIPDRFSNSGSGTDFTLTISRLEPEDFAVYYCQRYGSSRTFGQGTKVEIKR (SEQ ID NO: 46) | RASQSVSSSYLA (SEQ ID NO: 6) | GASSRAT (SEQ ID NO: 17) | QRYGSSRT (SEQ ID NO: 23) |
| 22 | LV-20 | DIVMTQSPLSLPVTPGEPASISCRSRSSQSLLHSNGYNYLDWYLQKPGQSPQLLLYLGSNRASGVPDRFSGSGSGTDFTLQISRVEAEDVGVYYCMQTLQTPFTFGPGTKVDIKR (SEQ ID NO: 47) | RSSQSLLHSNGYNYLD (SEQ ID NO: 7) | LGSNRAS (SEQ ID NO: 18) | MQTLQTPFT (SEQ ID NO: 24) |
| 23 | LV-21 | DIVMTQSPLSLPVTPGEPASISCRSRSSQSLLHSNGYNYLDWYLQKPGQSPQLLLYLGSNRASGVPDRFSGSGSGTDFTLKISRVEAEDVGVYYCMQTLQTPFTFGPGTKVDIKR (SEQ ID NO: 48) | RSSQSLLHSNGYNYLD (SEQ ID NO: 7) | LGSNRAS (SEQ ID NO: 18) | MQTLQTPFT (SEQ ID NO: 24) |
| 24 | LV-22 | EIVLTQSPGTLSLSPGERATLSCRARASQTVSRSYLSQTVSRSYLAWYQQKPGQAPRLLIYGASSRATGIPDRFSGSGSGTDFTLTISRLEPEDFAVFYCQQFGSSPWTFGQGTKVEIKR (SEQ ID NO: 49) | RASQTVSRSYLA (SEQ ID NO: 8) | GASSRAT (SEQ ID NO: 17) | QQFGSSPWT (SEQ ID NO: 25) |
| 25 | LV-23 | DIVMTQSPDSLAVSLGERATIHCKSSQNVLYSSNNKNFLTWYQQKPGQPPKLLIYRASTRESGVPDRFSGSGSGTDFTLTISSLQAEDVAVYFCQQYYSAPFTFGPGTKVDIKR (SEQ ID NO: 50) | KSSQNVLYSSNNKNFLT (SEQ ID NO: 9) | RASTRES (SEQ ID NO: 16) | QQYYSAPFT (SEQ ID NO: 22) |
| 26 | LV-24 | DIVMTQSPDSLAVSLGERTTIKCKSSQSVLYRSNNNNFLAWYQQKPGQPPKLLIYWASTRESGVPDRFSGSGSGTDFTLTISSLQAEDVAVYFCQQYYISPLTFGGGTKVEIKR (SEQ ID NO: 51) | KSSQSVLYRSNNNNFLA (SEQ ID NO: 10) | WASTRES (SEQ ID NO: 19) | QQYYISPLT (SEQ ID NO: 26) |
| 27 | LV-25 | DIVMTQSPDSLAVSLGERATINCKSSQSVLYSSNNKHYLAWYRQKPGQPPKLLIYRASTRESGVPDRFSGSGSGTDFTLTISSLQPEDVAVYYCQQYYSSPFTFGPGTKVDIKR (SEQ ID NO: 52) | KSSQSVLYSSNNKHYLA (SEQ ID NO: 11) | RASTRES (SEQ ID NO: 16) | QQYYSSPFT (SEQ ID NO: 27) |
| 28 | LV-26 | DIVMTQSPDSLAVSLGERATIHCKSSQSVLYSSNNRNFLSWYQQKPGQPPKLLIYRASTRESGVPDRFSGSGSGTDFTLTISSLQAEDVAVYFCQQYYSAPFTFGPGTTVDIKR (SEQ ID NO: 53) | KSSQSVLYSSNNRNFLS (SEQ ID NO: 12) | RASTRES (SEQ ID NO: 16) | QQYYSAPFT (SEQ ID NO: 22) |
| 29 | LV-27 | DIVMTQSPDSLAVSLGERATINCKSSQSVLYSSNNKNYLAWYRQKPGQPPKLLIYRASTRESGVPDRFSGS | KSSQSVLYSSNNKNYLA (SEQ ID NO: 16) | RASTRES | QQYYSSPFT (SEQ ID |

TABLE 1A-continued

Exemplary Anti-PAC1 Receptor Light Chain Variable Region Amino Acid Sequences

| Antibody ID. | VL Group | VL Amino Acid Sequence | CDRL1 | CDRL2 | CDRL3 |
|---|---|---|---|---|---|
| | | GSGTDFTLTISSLQAEDVAVYHCQ QYYSSPFTFGPGTKVDIKR (SEQ ID NO: 54) | NO: 13) | | NO: 27) |

TABLE 1B

Exemplary Anti-PAC1 Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| 01A, 01C, 01D, 02A, 02C | HV-01 | QVQLQQSGPGLVKPSQTLSLTCAI SGDSVSSNSATWNWIRQSPSRGL EWLGRTYYRSKWSNHYAVSVKS RITINPDTSKSQFSLQLNSVTPEDT AVYYCARGTWKQLWFLDHWGQ GTLVTVSS (SEQ ID NO: 83) | SNSATWN (SEQ ID NO: 55) | RTYYRSKW SNHYAVSV KS (SEQ ID NO: 66) | GTWKQLW FLDH (SEQ ID NO: 74) |
| 01B | HV-02 | QVQLQQSGPGLVKPSQTLSLTCAI SGDSVSSNSATWNWIRQSPSRKL EWLGRTYYRSKWSNHYAVSVKS RITINPDTSKSQFSLQLNSVTPEDT AVYYCARGTWKQLWFLDHWGQ GTLVTVSS (SEQ ID NO: 84) | SNSATWN (SEQ ID NO: 55) | RTYYRSKW SNHYAVSV KS (SEQ ID NO: 66) | GTWKQLW FLDH (SEQ ID NO: 74) |
| 03A, 03C, 03D, 09, 13, 15 | HV-03 | QVQLVESGAEVVKPGASVKVSCK ASGFTFSRFAMHWVRQAPGQGLE WMGVISYDGGNKYYAESVKGRV TMTRDTSTSTLYMELSSLRSEDTA VYYCARGYDVLTGYPDYWGQGT LVTVSS (SEQ ID NO: 85) | RFAMH (SEQ ID NO: 56) | VISYDGGN KYYAESVK G (SEQ ID NO: 67) | GYDVLTGY PDY (SEQ ID NO: 75) |
| 03B | HV-04 | QVQLVESGAEVVKPGASVKVSCK ASGFTFSRFAMHWVRQAPGQKLE WMGVISYDGGNKYYAESVKGRV TMTRDTSTSTLYMELSSLRSEDTA VYYCARGYDVLTGYPDYWGQGT LVTVSS (SEQ ID NO: 86) | RFAMH (SEQ ID NO: 56) | VISYDGGN KYYAESVK G (SEQ ID NO: 67) | GYDVLTGY PDY (SEQ ID NO: 75) |
| 04A, 04C, 04D | HV-05 | QVQLVESGGGVVQPGRSLRLSCA ASGFTFSRFAMHWVRQAPGKGLE WVAVISYDGGNKYYAESVKGRF TISRDNSKNTLYLQMNSLRAEDT ALFYCARGYDVLTGYPDYWGQG TLVTVSS (SEQ ID NO: 87) | RFAMH (SEQ ID NO: 56) | VISYDGGN KYYAESVK G (SEQ ID NO: 67) | GYDVLTGY PDY (SEQ ID NO: 75) |
| 04B | HV-06 | QVQLVESGGGVVQPGRSLRLSCA ASGFTFSRFAMHWVRQAPGKKLE WVAVISYDGGNKYYAESVKGRF TISRDNSKNTLYLQMNSLRAEDT ALFYCARGYDVLTGYPDYWGQG TLVTVSS (SEQ ID NO: 88) | RFAMH (SEQ ID NO: 56) | VISYDGGN KYYAESVK G (SEQ ID NO: 67) | GYDVLTGY PDY (SEQ ID NO: 75) |
| 05A, 05C, 05D | HV-07 | QVQLQESGPGLVKPSQTLSLTCTV SGGSISSGGYYWSWIRQHPGKGL EWIGYIYYSGNTYYNPSLKSRVTI SGDTSKNQFSLKLRSVTAADTAV YYCTRGGAARGMDVWGQGTTV TVSS (SEQ ID NO: 89) | SGGYYWS (SEQ ID NO: 57) | YIYYSGNT YYNPSLKS (SEQ ID NO: 68) | GGAARGM DV (SEQ ID NO: 76) |
| 05B | HV-08 | QVQLQESGPGLVKPSQTLSLTCTV SGGSISSGGYYWSWIRQHPGKKL EWIGYIYYSGNTYYNPSLKSRVTI | SGGYYWS (SEQ ID NO: 57) | YIYYSGNT YYNPSLKS (SEQ ID | GGAARGM DV SEQ ID |

TABLE 1B-continued

Exemplary Anti-PAC1 Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| | | SGDTSKNQFSLKLRSVTAADTAV YYCTRGGAARGMDVWGQGTTV TVSS (SEQ ID NO: 90) | | NO: 68) | (NO: 76) |
| 06A, 06C | HV-09 | QVQLQESGPGLVKPSETLSLTCTV SGGSISSGGYYWSWIRQPPGKGLE WIGYIYYSGNTYYNPSLKSRVTIS VDTSKNQFSLKLRSVTAADTAVY YCTRGGAARGMDVWGQGTTVT VSS (SEQ ID NO: 91) | SGGYYWS (SEQ ID NO: 57) | YIYYSGNT YYNPSLKS (SEQ ID NO: 68) | GGAARGM DV (SEQ ID NO: 76) |
| 06B | HV-10 | QVQLQESGPGLVKPSETLSLTCTV SGGSISSGGYYWSWIRQPPGKKLE WIGYIYYSGNTYYNPSLKSRVTIS VDTSKNQFSLKLRSVTAADTAVY YCTRGGAARGMDVWGQGTTVT VSS (SEQ ID NO: 92) | SGGYYWS (SEQ ID NO: 57) | YIYYSGNT YYNPSLKS (SEQ ID NO: 68) | GGAARGM DV (SEQ ID NO: 76) |
| 07 | HV-11 | QVQLVESGGGVVQPGRSLRLSCA ASGFTFSYYAIHWVRQAPGKGLE WVAVISYDGSNKYYADSVKGRF TISRDNSKNTLYLQMNSLRAEDT AVYYCARGYDLLTGYPDYWGQG TLVTVSS (SEQ ID NO: 93) | YYAIH (SEQ ID NO: 58) | VISYDGSN KYYADSVK G (SEQ ID NO: 69) | GYDLLTGY PDY (SEQ ID NO: 77) |
| 11, 14 | HV-12 | QVQLVESGGGVVQPGRSLRLSCA ASGFTFSRFAMHWVRRAPGKGLE WVAVISYDGGNKYYAESVKGRF TISRDNSKNTLNLLMNSLRAEDT ALFYCARGYDVLTGYPDYWGQG TLVTVSS (SEQ ID NO: 94) | RFAMH (SEQ ID NO: 56) | VISYDGGN KYYAESVK G (SEQ ID NO: 67) | GYDVLTGY PDY (SEQ ID NO: 75) |
| 08, 12 | HV-13 | QVQLVESGGGVVQPGRSLRLSCA ASGFTFSRFAMHWVRQAPGKGLE WVAVISYDGGNKYYAESVKGRF TISRDNSKNTLNLLMNSLRAEDT ALFYCARGYDVLTGYPDYWGQG TLVTVSS (SEQ ID NO: 95) | RFAMH (SEQ ID NO: 56) | VISYDGGN KYYAESVK G (SEQ ID NO: 67) | GYDVLTGY PDY (SEQ ID NO: 75) |
| 10 | HV-14 | QVQLVESGGGVVQPGRSLRLSCA ASGFTFSRFAMHWVRRAPGKGLE WVAVISYDGGNKYYAESVKGRF TISRDNSKNTLNLLMDSLRAEDT ALFYCARGYDVLTGYPDYWGQG TLVTVSS (SEQ ID NO: 96) | RFAMH (SEQ ID NO: 56) | VISYDGGN KYYAESVK G (SEQ ID NO: 67) | GYDVLTGY PDY (SEQ ID NO: 75) |
| 16 | HV-15 | QVQLVQSGAEVKKPGASVKVSC KASGFTFSRFAMHWVRQAPGQG LEWMGVISYDGGNKYYAESVKG RVTMTRDTSTSTAYMELSSLRSE DTAVYYCARGYDVLTGYPDYWG QGTLVTVSS (SEQ ID NO: 97) | RFAMH (SEQ ID NO: 56) | VISYDGGN KYYAESVK G (SEQ ID NO: 67) | GYDVLTGY PDY (SEQ ID NO: 75) |
| 17 | HV-16 | QVQLVQSGAEVKKPGASVKVSC AASGFTFSRFAMHWVRQAPGQG LEWMGVISYDGGNKYYAESVKG RVTMTRDNSKNTAYMELSSLRSE DTAVYYCARGYDVLTGYPDYWG QGTLVTVSS (SEQ ID NO: 98) | RFAMH (SEQ ID NO: 56) | VISYDGGN KYYAESVK G (SEQ ID NO: 67) | GYDVLTGY PDY (SEQ ID NO: 75) |
| 18 | HV-17 | EVQLLESGGGLVQPGGSLRLSCA ASGFTFSRFAMHWVRQAPGKGLE WVAVISYDGGNKYYAESVKGRF TISRDNSKNTLYLQMNSLRAEDT AVYYCARGYDVLTGYPDYWGQ | RFAMH (SEQ ID NO: 56) | VISYDGGN KYYAESVK G (SEQ ID NO: 67) | GYDVLTGY PDY (SEQ ID NO: 75) |

TABLE 1B-continued

Exemplary Anti-PAC1 Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| | | GTLVTVSS (SEQ ID NO: 99) | | | |
| 19, 20 | HV-18 | QVQLVESGGGVVQPGRSLRLSCA ASGFTFSRYAMHWVRQASGKGL EWVAVISYDGSNKYYADSVKGR FTISRDNSKNTLYLLMSSLRAEDT AVFYCARGYDILTGYPDYWGQG TLVTVSS (SEQ ID NO: 100) | RYAMH (SEQ ID NO: 59) | VISYDGSN KYYADSVK G (SEQ ID NO: 69) | GYDILTGY PDY (SEQ ID NO: 78) |
| 21 | HV-19 | QVQLVQSGAEVKKPGASVKVSC KASGYTFTSYGISWVRQAPGQGL EWMGWINAYNGHTNYAQTFQGR VTMTTDTSTSTAYMELRSLRSDD TAVYYCARELELRSFYYFGMDV WGQGTTVPVSS (SEQ ID NO: 101) | SYGIS (SEQ ID NO: 60) | WINAYNGH TNYAQTFQ G (SEQ ID NO: 70) | ELELRSFYY FGMDV (SEQ ID NO: 79) |
| 22 | HV-20 | QVQLVQSGAEVKKSGASLKVSCK ASGYIFTRYGVSWVRQAPGQGLE WMGWITTYNGNTNYAQKLQGR VTMTIDTSTSTAYMELRSLRSDDT AVYYCARRVRYSGGYSFDNWGQ GTLVTVSS (SEQ ID NO: 102) | RYGVS (SEQ ID NO: 61) | WITTYNGN TNYAQKLQ G (SEQ ID NO: 71) | RVRYSGGY SFDN (SEQ ID NO: 80) |
| 23 | HV-21 | QVQLVQSGAEVKKSGASLKVSCK ASGYIFTRYGVSWVRQAPGQGLE WMGWITTYNGNTNYAQKLQGR VTMTTDTSTSTAYMELRSLRSDD TAVYYCARRVRYSGGYSFDNWG QGTLVTVSS (SEQ ID NO: 103) | RYGVS (SEQ ID NO: 61) | WITTYNGN TNYAQKLQ G (SEQ ID NO: 71) | RVRYSGGY SFDN (SEQ ID NO: 80) |
| 24 | HV-22 | QVQLQESGPGLVKPSETLSLTCTV SGGSISSYYWSWIRQPAGKGLEWI GRIYTSGSTNYNPSLKSRVTMSIG TSKNQFSLKLSSVTAADTAVYYC AIIASRGWYFDLWGRGTLVTVSS (SEQ ID NO: 104) | SYYWS (SEQ ID NO: 62) | RIYTSGSTN YNPSLKS (SEQ ID NO: 72) | IASRGWYF DL (SEQ ID NO: 81) |
| 25, 28 | HV-23 | QVQLQESGPGLVKPSQTLSLTCTV SGGSISSGGYYWSWIRQHPGKGL EWIGYIYYSGNTYYNPSLKSRVTI SGDTSKNQFSLKLRSVTAADTAV YYCARGGAARGMDVWGQGTTV TVSS (SEQ ID NO: 105) | SGGYYWS (SEQ ID NO: 57) | YIYYSGNT YYNPSLKS (SEQ ID NO: 68) | GGAARGM DV (SEQ ID NO: 76) |
| 26 | HV-24 | QVQLQQSGPGLVKPSQTLSLTCAI SGDSVSSNSAAWNWIRQSPSRGL EWLGRTYYRSRWYNDYAVSVKS RITINPDTSKNQFSLQLNSVTPEDT AVYYCARGVFYSKGAFDIWGQG TMVTVSS (SEQ ID NO: 106) | SNSAAWN (SEQ ID NO: 63) | RTYYRSRW YNDYAVSV KS (SEQ ID NO: 73) | GVFYSKGA FDI (SEQ ID NO: 82) |
| 27 | HV-25 | QVQLQESGPGLVKPSQTLSLTCTV SGGSISRGGYYWSWIRQHPGKGL EWIGYIYYSGNTYYNPSLKSRVIIS GDTSKNQLSLKLRSVTAADTAVY YCARGGAARGMDVWGQGTTVT VSS (SEQ ID NO: 107) | RGGYYWS (SEQ ID NO: 64) | YIYYSGNT YYNPSLKS (SEQ ID NO: 68) | GGAARGM DV (SEQ ID NO: 76) |
| 29 | HV-26 | QVQLQESGPGLVKPSQTLSLTCTV SGGSISSGGFYWSWIRQHPGKGLE WIGYIYYSGNTYYNPSLKSRVIIS GDTSKNQFSLKLSSVTAADTAVY YCARGGAARGMDVWGQGTTVT VSS (SEQ ID NO: 108) | SGGFYWS (SEQ ID NO: 65) | YIYYSGNT YYNPSLKS (SEQ ID NO: 68) | GGAARGM DV (SEQ ID NO: 76) |

The anti-PAC1 receptor binding domain of the bispecific antigen binding proteins may comprise one or more of the CDRs presented in Table 1A (light chain CDRs; i.e. CDRLs) and Table 1B (heavy chain CDRs, i.e. CDRHs). For instance, in certain embodiments, the anti-PAC1 receptor binding domain comprises one or more light chain CDRs selected from (i) a CDRL1 selected from SEQ ID NOs: 1 to 13, (ii) a CDRL2 selected from SEQ ID NOs: 14 to 19, and (iii) a CDRL3 selected from SEQ ID NOs: 20 to 27, and (iv) a CDRL of (i), (ii) and (iii) that contains one or more, e.g., one, two, three, four or more amino acid substitutions (e.g., conservative amino acid substitutions), deletions or insertions of no more than five, four, three, two, or one amino acids. In these and other embodiments, the anti-PAC1 receptor binding domain comprises one or more heavy chain CDRs selected from (i) a CDRH1 selected from SEQ ID NOs: 55 to 65, (ii) a CDRH2 selected from SEQ ID NOs: 66 to 73, and (iii) a CDRH3 selected from SEQ ID NOs: 74 to 82, and (iv) a CDRH of (i), (ii) and (iii) that contains one or more, e.g., one, two, three, four or more amino acid substitutions (e.g., conservative amino acid substitutions), deletions or insertions of no more than five, four, three, two, or one amino acids amino acids.

In certain embodiments, the anti-PAC1 receptor binding domain may comprise 1, 2, 3, 4, 5, or 6 variant forms of the CDRs listed in Tables 1A and 1B, each having at least 80%, 85%, 90% or 95% sequence identity to a CDR sequence listed in Tables 1A and 1B. In some embodiments, the anti-PAC1 receptor binding domain includes 1, 2, 3, 4, 5, or 6 of the CDRs listed in Tables 1A and 1B, each differing by no more than 1, 2, 3, 4 or 5 amino acids from the CDRs listed in these tables.

In particular embodiments, the anti-PAC1 receptor binding domain of the bispecific antigen binding proteins of the invention comprises a light chain variable region comprising a CDRL1, a CDRL2, and a CDRL3, wherein: (a) CDRL1, CDRL2, and CDRL3 have the sequence of SEQ ID NOs: 1, 14 and 20, respectively; (b) CDRL1, CDRL2, and CDRL3 have the sequence of SEQ ID NOs: 2, 15 and 21, respectively; (c) CDRL1, CDRL2, and CDRL3 have the sequence of SEQ ID NOs: 3, 15 and 21, respectively; (d) CDRL1, CDRL2, and CDRL3 have the sequence of SEQ ID NOs: 4, 16 and 22, respectively; (e) CDRL1, CDRL2, and CDRL3 have the sequence of SEQ ID NOs: 5, 15 and 21, respectively; (f) CDRL1, CDRL2, and CDRL3 have the sequence of SEQ ID NOs: 6, 17 and 23, respectively; (g) CDRL1, CDRL2, and CDRL3 have the sequence of SEQ ID NOs: 7, 18 and 24, respectively; (h) CDRL1, CDRL2, and CDRL3 have the sequence of SEQ ID NOs: 8, 17 and 25, respectively; (i) CDRL1, CDRL2, and CDRL3 have the sequence of SEQ ID NOs: 9, 16 and 22, respectively; (j) CDRL1, CDRL2, and CDRL3 have the sequence of SEQ ID NOs: 10, 19 and 26, respectively; (k) CDRL1, CDRL2, and CDRL3 have the sequence of SEQ ID NOs: 11, 16 and 27, respectively; (l) CDRL1, CDRL2, and CDRL3 have the sequence of SEQ ID NOs: 12, 16 and 22, respectively; or (m) CDRL1, CDRL2, and CDRL3 have the sequence of SEQ ID NOs: 13, 16 and 27, respectively.

In other particular embodiments, the anti-PAC1 receptor binding domain of the bispecific antigen binding proteins of the invention comprises a heavy chain variable region comprising a CDRH1, a CDRH2, and a CDRH3, wherein: (a) CDRH1, CDRH2, and CDRH3 have the sequence of SEQ ID NOs: 55, 66 and 74, respectively; (b) CDRH1, CDRH2, and CDRH3 have the sequence of SEQ ID NOs: 56, 67 and 75, respectively; (c) CDRH1, CDRH2, and CDRH3 have the sequence of SEQ ID NOs: 57, 68 and 76, respectively; (d) CDRH1, CDRH2, and CDRH3 have the sequence of SEQ ID NOs: 58, 69 and 77, respectively; (e) CDRH1, CDRH2, and CDRH3 have the sequence of SEQ ID NOs: 59, 69 and 78, respectively; (f) CDRH1, CDRH2, and CDRH3 have the sequence of SEQ ID NOs: 60, 70 and 79, respectively; (g) CDRH1, CDRH2, and CDRH3 have the sequence of SEQ ID NOs: 61, 71 and 80, respectively; (h) CDRH1, CDRH2, and CDRH3 have the sequence of SEQ ID NOs: 62, 72 and 81, respectively; (i) CDRH1, CDRH2, and CDRH3 have the sequence of SEQ ID NOs: 63, 73 and 82, respectively; (j) CDRH1, CDRH2, and CDRH3 have the sequence of SEQ ID NOs: 64, 68 and 76, respectively; or (k) CDRH1, CDRH2, and CDRH3 have the sequence of SEQ ID NOs: 65, 68 and 76, respectively.

In certain embodiments, the anti-PAC1 receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 1, 14 and 20, respectively, and CDRH1, CDRH2, and CDRH3 have the sequence of SEQ ID NOs: 55, 66 and 74, respectively;

(b) CDRL1, CDRL2, and CDRL3 have the sequence of SEQ ID NOs: 2, 15 and 21, respectively, and CDRH1, CDRH2, and CDRH3 have the sequence of SEQ ID NOs: 56, 67 and 75, respectively;

(c) CDRL1, CDRL2, and CDRL3 have the sequence of SEQ ID NOs: 3, 15 and 21, respectively, and CDRH1, CDRH2, and CDRH3 have the sequence of SEQ ID NOs: 56, 67 and 75, respectively;

(d) CDRL1, CDRL2, and CDRL3 have the sequence of SEQ ID NOs: 4, 16 and 22, respectively, and CDRH1, CDRH2, and CDRH3 have the sequence of SEQ ID NOs: 57, 68 and 76, respectively;

(e) CDRL1, CDRL2, and CDRL3 have the sequence of SEQ ID NOs: 5, 15 and 21, respectively, and CDRH1, CDRH2, and CDRH3 have the sequence of SEQ ID NOs: 58, 69 and 77, respectively;

(f) CDRL1, CDRL2, and CDRL3 have the sequence of SEQ ID NOs: 2, 15 and 21, respectively, and CDRH1, CDRH2, and CDRH3 have the sequence of SEQ ID NOs: 59, 69 and 78, respectively;

(g) CDRL1, CDRL2, and CDRL3 have the sequence of SEQ ID NOs: 6, 17 and 23, respectively, and CDRH1, CDRH2, and CDRH3 have the sequence of SEQ ID NOs: 60, 70 and 79, respectively;

(h) CDRL1, CDRL2, and CDRL3 have the sequence of SEQ ID NOs: 7, 18 and 24, respectively, and CDRH1, CDRH2, and CDRH3 have the sequence of SEQ ID NOs: 61, 71 and 80, respectively;

(i) CDRL1, CDRL2, and CDRL3 have the sequence of SEQ ID NOs: 8, 17 and 25, respectively, and CDRH1, CDRH2, and CDRH3 have the sequence of SEQ ID NOs: 62, 72 and 81, respectively;

(j) CDRL1, CDRL2, and CDRL3 have the sequence of SEQ ID NOs: 9, 16 and 22, respectively, and CDRH1, CDRH2, and CDRH3 have the sequence of SEQ ID NOs: 57, 68 and 76, respectively;

(k) CDRL1, CDRL2, and CDRL3 have the sequence of SEQ ID NOs: 10, 19 and 26, respectively, and CDRH1, CDRH2, and CDRH3 have the sequence of SEQ ID NOs: 63, 73 and 82, respectively;

(l) CDRL1, CDRL2, and CDRL3 have the sequence of SEQ ID NOs: 11, 16 and 27, respectively, and CDRH1, CDRH2, and CDRH3 have the sequence of SEQ ID NOs: 64, 68 and 76, respectively;

(m) CDRL1, CDRL2, and CDRL3 have the sequence of SEQ ID NOs: 12, 16 and 22, respectively, and CDRH1, CDRH2, and CDRH3 have the sequence of SEQ ID NOs: 57, 68 and 76, respectively; or (n) CDRL1, CDRL2, and CDRL3 have the sequence of SEQ ID NOs: 13, 16 and 27, respectively, and CDRH1, CDRH2, and CDRH3 have the sequence of SEQ ID NOs: 65, 68 and 76, respectively.

In some embodiments, the anti-PAC1 receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 1, 14 and 20, respectively, and CDRH1, CDRH2, and CDRH3 have the sequence of SEQ ID NOs: 55, 66 and 74, respectively;

(b) CDRL1, CDRL2, and CDRL3 have the sequence of SEQ ID NOs: 2, 15 and 21, respectively, and CDRH1, CDRH2, and CDRH3 have the sequence of SEQ ID NOs: 56, 67 and 75, respectively;

(c) CDRL1, CDRL2, and CDRL3 have the sequence of SEQ ID NOs: 3, 15 and 21, respectively, and CDRH1, CDRH2, and CDRH3 have the sequence of SEQ ID NOs: 56, 67 and 75, respectively; or (d) CDRL1, CDRL2, and CDRL3 have the sequence of SEQ ID NOs: 4, 16 and 22, respectively, and CDRH1, CDRH2, and CDRH3 have the sequence of SEQ ID NOs: 57, 68 and 76, respectively.

The anti-PAC1 receptor binding domain of the antigen binding proteins of the invention may comprise a light chain variable region selected from the group consisting of LV-01, LV-02, LV-03, LV-04, LV-05, LV-06, LV-07, LV-08, LV-09, LV-10, LV-11, LV-12, LV-13, LV-14, LV-15, LV-16, LV-17, LV-18, LV-19, LV-20, LV-21, LV-22, LV-23, LV-24, LV-25, LV-26, and LV-27, as shown in Table 1A, and/or a heavy chain variable region selected from the group consisting of HV-01, HV-02, HV-03, HV-04, HV-05, HV-06, HV-07, HV-08, HV-09, HV-10, HV-11, HV-12, HV-13, HV-14, HV-15, HV-16, HV-17, HV-18, HV-19, HV-20, HV-21, HV-22, HV-23, HV-24, HV-25, and HV-26 as shown in Table 1B, and functional fragments, derivatives, muteins and variants of these light chain and heavy chain variable regions.

Each of the light chain variable regions listed in Table 1A may be combined with any of the heavy chain variable regions shown in Table 1B to form an anti-PAC1 receptor binding domain suitable for incorporation into the bispecific antigen binding proteins of the invention. Examples of such combinations include, but are not limited to: LV-01 and HV-01; LV-02 and HV-02; LV-03 and HV-01; LV-04 and HV-03; LV-05 and HV-04; LV-06 and HV-05; LV-07 and HV-06; LV-08 and HV-07; LV-09 and HV-08; LV-10 and HV-09; LV-11 and HV-10; LV-12 and HV-11; LV-13 and HV-13; LV-13 and HV-03; LV-13 and HV-14; LV-14 and HV-12; LV-15 and HV-13; LV-15 and HV-03; LV-15 and HV-12; LV-16 and HV-03; LV-16 and HV-15; LV-16 and HV-16; LV-16 and HV-17; LV-17 and HV-18; LV-18 and HV-18; LV-19 and HV-19; LV-20 and HV-20; LV-21 and HV-21; LV-22 and HV-22; LV-23 and HV-23; LV-24 and HV-24; LV-25 and HV-25; LV-26 and HV-23; and LV-27 and HV-26. In certain embodiments, the anti-PAC1 receptor binding domain comprises: (a) LV-01 (SEQ ID NO: 28) and HV-01 (SEQ ID NO: 83); (b) LV-03 (SEQ ID NO: 30) and HV-01 (SEQ ID NO: 83); (c) LV-04 (SEQ ID NO: 31) and HV-03 (SEQ ID NO: 85); (d) LV-06 (SEQ ID NO: 33) and HV-05 (SEQ ID NO: 87); (e) LV-08 (SEQ ID NO: 35) and HV-07 (SEQ ID NO: 89); or (f) LV-10 (SEQ ID NO: 37) and HV-09 (SEQ ID NO: 91).

In some embodiments, the anti-PAC1 receptor binding domain comprises a light chain variable region comprising a sequence of contiguous amino acids that differs from the sequence of a light chain variable region in Table 1A, i.e. a VL selected from LV-01, LV-02, LV-03, LV-04, LV-05, LV-06, LV-07, LV-08, LV-09, LV-10, LV-11, LV-12, LV-13, LV-14, LV-15, LV-16, LV-17, LV-18, LV-19, LV-20, LV-21, LV-22, LV-23, LV-24, LV-25, LV-26, and LV-27 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some anti-PAC1 binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 28-54 (i.e. the light chain variable regions in Table 1A).

In these and other embodiments, the anti-PAC1 receptor binding domain comprises a heavy chain variable region comprising a sequence of contiguous amino acids that differs from the sequence of a heavy chain variable region in Table 1B, i.e., a VH selected from HV-01, HV-02, HV-03, HV-04, HV-05, HV-06, HV-07, HV-08, HV-09, HV-10, HV-11, HV-12, HV-13, HV-14, HV-15, HV-16, HV-17, HV-18, HV-19, HV-20, HV-21, HV-22, HV-23, HV-24, HV-25, and HV-26 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some anti-PAC1 receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 83-108 (i.e. the heavy chain variable regions in Table 1B).

The term "identity," as used herein, refers to a relationship between the sequences of two or more polypeptide molecules or two or more nucleic acid molecules, as determined by aligning and comparing the sequences. "Percent identity," as used herein, means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York:

Academic Press; Sequence Analysis Primer, (Gribskov, M. and Devereux, J., eds.), 1991, New York: M. Stockton Press; and Carillo et al., 1988, SIAM J. Applied Math. 48:1073. For example, sequence identity can be determined by standard methods that are commonly used to compare the similarity in position of the amino acids of two polypeptides. Using a computer program such as BLAST or FASTA, two polypeptide or two polynucleotide sequences are aligned for optimal matching of their respective residues (either along the full length of one or both sequences, or along a predetermined portion of one or both sequences). The programs provide a default opening penalty and a default gap penalty, and a scoring matrix such as PAM 250 (a standard scoring matrix; see Dayhoff et al., in Atlas of Protein Sequence and Structure, vol. 5, supp. 3 (1978)) can be used in conjunction with the computer program. For example, the percent identity can then be calculated as: the total number of identical matches multiplied by 100 and then divided by the sum of the length of the longer sequence within the matched span and the number of gaps introduced into the longer sequences in order to align the two sequences. In calculating percent identity, the sequences being compared are aligned in a way that gives the largest match between the sequences.

The GCG program package is a computer program that can be used to determine percent identity, which package includes GAP (Devereux et al., 1984, Nucl. Acid Res. 12:387; Genetics Computer Group, University of Wisconsin, Madison, Wis.). The computer algorithm GAP is used to align the two polypeptides or two polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix; Henikoff et al., 1992, Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program include the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences may result in matching of only a short region of the two sequences, and this small aligned region may have very high sequence identity even though there is no significant relationship between the two full-length sequences. Accordingly, the selected alignment method (GAP program) can be adjusted if so desired to result in an alignment that spans at least 50 contiguous amino acids of the target polypeptide.

The bispecific antigen binding proteins of the invention comprise a binding domain that specifically binds to the human CGRP receptor. The human CGRP receptor (also referred to herein as "CGRPR," "CGRP R," "hCGRPR," and "huCGRPR") is a heterodimer that comprises the human calcitonin receptor-like receptor (CRLR) polypeptide (Genbank Accession No. U17473.1) and the human receptor activity modifying protein 1 (RAMP1) polypeptide (Genbank Accession No. AJ001014). The amino acid sequences for the full-length human CRLR and RAMP1 polypeptides as well as extracellular domains from both polypeptides are set forth in Table 2 below.

TABLE 2

Sequences of human CRLR and human RAMP1 polypeptides

| Polypeptide | Sequence |
|---|---|
| Human CRLR | MLYSIFHFGLMMEKKCTLYFLVLLPFFMILVTAELEESPEDSIQLGVTRNKIMTAQYE CYQKIMQDPIQQAEGVYCNRTWDGWLCWNDVAAGTESMQLCPDYFQDFDPSEKVT KICDQDGNWFRHPASNRTWTNYTQCNVNTHEKVKTALNLFYLTIIGHGLSIASLLISL GIFFYFKSLSCQRITLHKNLFFSFVCNSVVTIIHLTAVANNQALVATNPVSCKVSQFIH LYLMGCNYFWMLCEGIYLHTLIVVAVFAEKQHLMWYYFLGWGFPLIPACIHAIARS LYYNDNCWISSDTHLLYIIHGPICAALLVNLFFLLNIVRVLITKLKVTHQAESNLYMK AVRATLILVPLLGIEFVLIPWRPEGKIAEEVYDYIMHILMHFQGLLVSTIFCFFNGEVQ AILRRNWNQYKIQFGNSFSNSEALRSASYTVSTISDGPGYSHDCPSEHLNGKSIHDIEN VLLKPENLYN (SEQ ID NO: 340) |
| Human RAMP1 | MARALCRLPRRGLWLLLAHHLFMTTACQEANYGALLRELCLTQFQVDMEAVGETL WCDWGRTIRSYRELADCTWHMAEKLGCFWPNAEVDRFFLAVHGRYFRSCPISGRA VRDPPGSILYPFIVVPITVTLLVTALVVWQSKRTEGIV (SEQ ID NO: 341) |
| Extracellular Domain of Human CRLR | ELEESPEDSIQLGVTRNKIMTAQYECYQKIMQDPIQQAEGVYCNRTWDGWLCWNDV AAGTESMQLCPDYFQDFDPSEKVTKICDQDGNWFRHPASNRTWTNYTQCNVNTHE KVKTA (SEQ ID NO: 342) |
| Extracellular Domain of Human RAMP1 | CQEANYGALLRELCLTQFQVDMEAVGETLWCDWGRTIRSYRELADCTWHMAEKL GCFWPNAEVDRFFLAVHGRYFRSCPISGRAVRDPPGS (SEQ ID NO: 343) |

In certain embodiments, the anti-CGRP receptor binding domain of the bispecific antigen binding proteins of the invention comprises the VH region and/or the VL region or CDR regions from an anti-CGRP receptor antibody or functional fragment thereof. Preferably, the anti-CGRP receptor antibody or functional fragment thereof specifically binds to human CGRP receptor and prevents or reduces binding of the receptor to CGRP. In certain embodiments, the anti-CGRP receptor antibody or functional fragment thereof specifically binds to residues or sequences of residues, or regions in both human CRLR and human RAMP1 polypeptides. In one embodiment, the anti-CGRP receptor antibody or functional fragment thereof specifically binds to an epitope formed from amino acids in both human CRLR and human RAMP1 polypeptides. As used herein, an "epitope" refers to any determinant capable of being specifically bound by an antibody or functional fragment thereof. An epitope can be contiguous or non-contiguous (e.g., (i) in a single-chain polypeptide, amino acid residues that are not contiguous to one another in the polypeptide sequence but that within in context of the molecule are bound by the antibody or functional fragment, or (ii) in a multimeric protein, e.g., comprising two or more individual components, amino acid residues present on two or more of the individual components, but that within the context of the multimeric protein are bound by the antibody or functional fragment). In some embodiments, the epitope formed from amino acids in both human CRLR and human RAMP1 polypeptides comprises one or more cleavage sites for AspN protease, which cleaves peptides after aspartic acid residues and some glutamic acid residues at the amino end.

In certain embodiments, the anti-CGRP receptor antibody or functional fragment thereof from which the anti-CGRP receptor binding domain is derived specifically binds to an extracellular domain of human CRLR polypeptide comprising the amino acid sequence of SEQ ID NO: 342. Alternatively or additionally, the anti-CGRP receptor antibody or functional fragment thereof specifically binds to an extracellular domain of human RAMP1 polypeptide comprising the amino acid sequence of SEQ ID NO: 343. In some embodiments, the anti-CGRP receptor antibody or binding fragment specifically binds to an epitope within the human CRLR polypeptide comprising at least one sequence selected from SEQ ID NO: 344 (DSIQLGVTRN-KIMTAQY; corresponding to amino acids 8-24 of SEQ ID NO: 342), SEQ ID NO: 345 (DVAAGTESMQLCP; corresponding to amino acids 55-67 of SEQ ID NO: 342), SEQ ID NO: 346 (DGNWFRHPASNRTWTNYTQCNVNTH; corresponding to amino acids 86-110 of SEQ ID NO: 342), SEQ ID NO: 347 (ECYQKIMQ; corresponding to amino acids 25-32 of SEQ ID NO: 342), or SEQ ID NO: 348 (DGWLCWN; corresponding to amino acids 48-54 of SEQ ID NO: 342). For example, in some embodiments, the anti-CGRP receptor antibody or functional fragment thereof binds an epitope within a subregion of human CRLR polypeptide of SEQ ID NO: 342, wherein the epitope comprises SEQ ID NOs: 344-348, optionally in its native three-dimensional conformation. Alternatively or additionally, the anti-CGRP receptor antibody or functional fragment specifically binds to at least one epitope within the human RAMP1 polypeptide selected from SEQ ID NO: 349 (RELADCT-WHMAE; corresponding to amino acids 41-52 of SEQ ID NO: 343), SEQ ID NO: 350 (DWGRTIRSYRELA; corresponding to amino acids 32-44 of SEQ ID NO: 343), SEQ ID NO: 351 (ELCLTQFQV; corresponding to amino acids 12-20 of SEQ ID NO: 343), or SEQ ID NO: 352 (DCT-WHMA; corresponding to amino acids 45-51 of SEQ ID NO: 343). In some embodiments, the anti-CGRP receptor antibody or functional fragment thereof binds to an epitope within a subregion of human RAMP1 polypeptide of SEQ ID NO: 343, wherein the epitope comprises SEQ ID NOs: 349-352, optionally in its native three-dimensional conformation.

In some embodiments, the anti-CGRP receptor antibody or functional fragment thereof from which the anti-CGRP receptor binding domain of the bispecific antigen binding proteins of the invention is derived selectively inhibits the human CGRP receptor relative to the human adrenomedullin 1(AM1), human adrenomedullin 2 (AM2), or human amylin receptors (e.g. human AMY1 receptor). The human AM1 receptor is comprised of a human CRLR polypeptide and a RAMP2 polypeptide, whereas the human AM2 receptor is comprised of a human CRLR polypeptide and a RAMP3 polypeptide. Thus, an antibody or other binding protein that binds only CRLR (and not RAMP1) would not be expected to selectively inhibit the CGRP receptor because the CRLR polypeptide is also a component of the AM1 and AM2 receptors. The human amylin (AMY) receptors are comprised of a human calcitonin receptor (CT) polypeptide and one of the RAMP1, RAMP2, or RAMP3 subunits. Specifically, the human AMY1 receptor is composed of the CT polypeptide and the RAMP1 polypeptide, the human AMY2 receptor is composed of the CT polypeptide and the RAMP2 polypeptide, and the human AMY3 receptor is composed of the CT polypeptide and the RAMP3 polypeptide. Thus, an antibody or other binding protein that binds only RAMP1 (and not CRLR) would not be expected to selectively inhibit the CGRP receptor because the RAMP1 polypeptide is also a component of the human AMY1 receptor. As described above, the ability of any antibody or functional fragment thereof to selectively inhibit a particular receptor (e.g. human CGRP receptor) relative to a reference receptor (e.g. human AM1, AM2, or AMY1 receptors) can be assessed by determining the IC50 value of the antibody or functional fragment in an inhibition assay for the target and reference receptors. The IC50 value for any anti-CGRP receptor antibody or functional fragment thereof can be calculated by determining the concentration of the antibody or fragment needed to inhibit half of the maximum biological response of the CGRP ligand in activating the human CGRP receptor in any functional assay, such as the cAMP assay described in the Examples. In some embodiments, the anti-CGRP receptor antibody or functional fragment thereof from which the anti-CGRP receptor binding domain of the bispecific antigen binding proteins of the invention is derived is a neutralizing antibody or fragment of the human CGRP receptor.

The variable regions or CDR regions of any anti-CGRP receptor antibody or functional fragment thereof can be used to construct the anti-CGRP receptor binding domain of any of the bispecific antigen binding proteins described herein. For instance, the anti-CGRP receptor binding domain of the bispecific antigen binding proteins of the invention may comprise VH and/or VL regions or one or more CDRs from any of the anti-human CGRP receptor antibodies described in WO 2010/075238, which is hereby incorporated by reference in its entirety. In some embodiments, the anti-CGRP receptor antibody from which the anti-CGRP receptor binding domain is derived competes for binding of the human CGRP receptor with one or more of the human anti-CGRP receptor antibodies described in WO 2010/075238 or one or more of the anti-CGRP receptor antibodies described below. In some embodiments, a competing antibody or binding fragment thereof reduces human CGRP receptor binding of a reference antibody between about 40% and 100%, such as about 60% and about 100%, specifically between about 70% and 100%, and more specifically between about 80% and 100%. A particularly suitable quantitative assay for detecting competitive binding uses a Biacore machine which measures the extent of interactions using surface plasmon resonance technology. Another suitable quantitative competition binding assay uses a FACS-based approach to measure competition between antibodies in terms of their binding to the human CGRP receptor.

Light chain and heavy chain variable regions and associated CDRs of exemplary human anti-CGRP receptor antibodies from which the anti-CGRP receptor binding domain of the bispecific antigen binding proteins of the invention can be derived or constructed are set forth below in Tables 3A and 3B, respectively.

TABLE 3A

Exemplary Anti-CGRP Receptor Light Chain Variable Region Amino Acid Sequences

| Antibody ID. | VL Group | VL Amino Acid Sequence | CDRL1 | CDRL2 | CDRL3 |
|---|---|---|---|---|---|
| 50A, 50C, 50D, 70 | LV-101 | QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGGGTKLTVLG (SEQ ID NO: 136) | SGSSSNIGSNYVY (SEQ ID NO: 109) | RNNQRPS (SEQ ID NO: 120) | AAWDDSLSGWV (SEQ ID NO: 127) |
| 50B | LV-102 | QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGKGTKLTVLG (SEQ ID NO: 137) | SGSSSNIGSNYVY (SEQ ID NO: 109) | RNNQRPS (SEQ ID NO: 120) | AAWDDSLSGWV (SEQ ID NO: 127) |
| 51A, 51C, 51D | LV-103 | QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGGGTKLTVLG (SEQ ID NO: 138) | SGSSSNIGSNYVY (SEQ ID NO: 109) | RNNQRPS (SEQ ID NO: 120) | AAWDDSLSGWV (SEQ ID NO: 127) |
| 51B | LV-104 | QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGKGTKLTVLG (SEQ ID NO: 139) | SGSSSNIGSNYVY (SEQ ID NO: 109) | RNNQRPS (SEQ ID NO: 120) | AAWDDSLSGWV (SEQ ID NO: 127) |
| 52A, 52C, 52D, 53A, 53C | LV-105 | QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLG (SEQ ID NO: 140) | SGSSSNIGNNYVS (SEQ ID NO: 110) | DNNKRPS (SEQ ID NO: 121) | GTWDSRLSAVV (SEQ ID NO: 128) |
| 52B, 53B | LV-106 | QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGKGTKLTVLG (SEQ ID NO: 141) | SGSSSNIGNNYVS (SEQ ID NO: 110) | DNNKRPS (SEQ ID NO: 121) | GTWDSRLSAVV (SEQ ID NO: 128) |
| 54A, 54C, 56A, 56C, 71 | LV-107 | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLG (SEQ ID NO: 142) | SGSSSNIGNNYVS (SEQ ID NO: 110) | DNNKRPS (SEQ ID NO: 121) | GTWDSRLSAVV (SEQ ID NO: 128) |
| 54B, 56B | LV-108 | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGKGTKLTVLG (SEQ ID NO: 143) | SGSSSNIGNNYVS (SEQ ID NO: 110) | DNNKRPS (SEQ ID NO: 121) | GTWDSRLSAVV (SEQ ID NO: 128) |
| 55A, 55C | LV-109 | QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVLG (SEQ ID NO: 144) | SGSSSNIGNNYVS (SEQ ID NO: 110) | DNNKRPS (SEQ ID NO: 121) | GTWDSRLSAVV (SEQ ID NO: 128) |

TABLE 3A-continued

Exemplary Anti-CGRP Receptor Light Chain Variable Region Amino Acid Sequences

| Antibody ID. | VL Group | VL Amino Acid Sequence | CDRL1 | CDRL2 | CDRL3 |
|---|---|---|---|---|---|
| 55B | LV-110 | QSVLTQPPSVSAAPGQKVTISCSG SSSNIGNNYVSWYQQLPGTAPKL LIYDNNKRPSGIPDRFSGSKSGTS ATLAITGLQTGDEADYYCGTWDS RLSAVVFGKGTKLTVLG (SEQ ID NO: 145) | SGSSSNIGNNY VS (SEQ ID NO: 110) | DNNKRPS (SEQ ID NO: 121) | GTWDSRLS AVV (SEQ ID NO: 128) |
| 57A, 57C, 57D, 58A, 58C | LV-111 | EIVLTQSPGTLSLSPGERATLSCRA SQSVSSGYLTWYQQKPGQAPRLL IYGASSRATGIPDRFSGSGSGTDFT LTISRLEPEDFAVYYCQQYGNSLS RFGQGTKLEIKR (SEQ ID NO: 146) | RASQSVSSGYL T (SEQ ID NO: 111) | GASSRAT (SEQ ID NO: 17) | QQYGNSLS R (SEQ ID NO: 129) |
| 57B, 58B | LV-112 | EIVLTQSPGTLSLSPGERATLSCRA SQSVSSGYLTWYQQKPGQAPRLL IYGASSRATGIPDRFSGSGSGTDFT LTISRLEPEDFAVYYCQQYGNSLS RFGKGTKLEIKR (SEQ ID NO: 147) | RASQSVSSGYL T (SEQ ID NO: 111) | GASSRAT (SEQ ID NO: 17) | QQYGNSLS R (SEQ ID NO: 129) |
| 59 | LV-113 | QSVLTQPPSVSEAPGQKVTISCSG SSSNIGNNYVSWYQQLPGTAPKL LIYDNNKRPSGIPDRFSGSKSGTS ATLGITGLQTGDEADYYCGTWDS RLSAVVFGGGTKLTVL (SEQ ID NO: 148) | SGSSSNIGNNY VS (SEQ ID NO: 110) | DNNKRPS (SEQ ID NO: 121) | GTWDSRLS AVV (SEQ ID NO: 128) |
| 60 | LV-114 | QSVLTQPPSASGTPGQRVTISCSG SSSNIGSNYVYWYQQLPGAAPKL LIFRSNQRPSGVPDRFSGSKSGTS ASLAISGLRSEDEADYYCAAWDD SLSGWVFGGGTKLTVL (SEQ ID NO: 149) | SGSSSNIGSNYV Y (SEQ ID NO: 109) | RSNQRPS (SEQ ID NO: 122) | AAWDDSLS GWV (SEQ ID NO: 127) |
| 61 | LV-115 | DIQMTQSPSSLSASVGDRVTITCR ASQGIRNDLGWFQQKPGKAPKRL IYAASSLQSGVPSRFSGSGSGTEFT LTISSLQPEDLATYYCLQYNIYPW TFGQGTKVEIK (SEQ ID NO: 150) | RASQGIRNDLG (SEQ ID NO: 112) | AASSLQS (SEQ ID NO: 14) | LQYNIYPW T (SEQ ID NO: 130) |
| 62 | LV-116 | SSELTQDPTVSVALGQTVKITCQG DSLRSFYASWYQQKPGQAPVLVF YGKNNRPSGIPDRFSGSSSGNTAS LTITGAQAEDEADYYCNSRDSSV YHLVLGGGTKLTVL (SEQ ID NO: 151) | QGDSLRSFYAS (SEQ ID NO: 113) | GKNNRPS (SEQ ID NO: 123) | NSRDSSVY HLV (SEQ ID NO: 131) |
| 63 | LV-117 | DIILAQTPLSLSVTPGQPASISCKSS QSLLHSAGKTYLYWYLQKPGQPP QLLIYEVSNRFSGVPDRFSGSGSG TDFTLKISRVEAEDVGIYYCMQSF PLPLTFGGGTKVEIK (SEQ ID NO: 152) | KSSQSLLHSAG KTYLY (SEQ ID NO: 114) | EVSNRFS (SEQ ID NO: 124) | MQSFPLPLT (SEQ ID NO: 132) |
| 64 | LV-118 | DIVMTQSPLSLPVTPGEPASISCRS SQSLLHSFGYNYLDWYLQKPGQS PQLLIYLGSNRASGVPDRFSGSGS GTDFTLKISRVEAEDVGVYYCMQ ALQTPFTFGPGTKVDIK (SEQ ID NO: 153) | RSSQSLLHSFG YNYLD (SEQ ID NO: 115) | LGSNRAS (SEQ ID NO: 18) | MQALQTPF T (SEQ ID NO: 133) |
| 65 | LV-119 | DIILTQTPLSLSVTPGQPASISCKSS QSLLHSDGKTYLYWYLQKPGQPP QLLIYEVSNRFSGEPDRFSGSGSG TDFTLKISRVEAEDVGTYYCMQS FPLPLTFGGGTKVEIK (SEQ ID NO: 154) | KSSQSLLHSDG KTYLY (SEQ ID NO: 116) | EVSNRFS (SEQ ID NO: 124) | MQSFPLPLT (SEQ ID NO: 132) |
| 66 | LV-120 | QSVLTQPPSVSAAPGQKVTISCSG SSSNIGNNYVSWYQQFPGTAPKL LIYDNNKRPSGIPDRFSGSKSGTS ATLGITGLQTGDEADYYCGTWDS | SGSSSNIGNNY VS (SEQ ID NO: 110) | DNNKRPS (SEQ ID NO: 121) | GTWDSRLS AVV (SEQ ID NO: 128) |

TABLE 3A-continued

Exemplary Anti-CGRP Receptor Light Chain Variable Region Amino Acid Sequences

| Antibody ID. | VL Group | VL Amino Acid Sequence | CDRL1 | CDRL2 | CDRL3 |
|---|---|---|---|---|---|
| | | RLSAVVFGGGTKLTVL (SEQ ID NO: 155) | | | |
| 67 | LV-121 | QSVLTQPPSASGTPGQRVTISCSGSSSNIGSNTVNWYQQLPGTAPKLLIYTNNQRPSGVPDRFSGSKSGTSASLAISGLQSEDEADFYCAARDESLNGVVFGGGTKLTVL (SEQ ID NO: 156) | SGSSSNIGSNTVN (SEQ ID NO: 117) | TNNQRPS (SEQ ID NO: 125) | AARDESLNGVV (SEQ ID NO: 134) |
| 68 | LV-122 | DITLTQTPLSLSVSPGQPASISCKSSQSLLHSDGRNYLYWYLQKPGQPPQLLIYEVSNRFSGLPDRFSGSGSGTDFTLKISRVEAEDVGIYYCMQSFPLPLTFGGGTKVEIK (SEQ ID NO: 157) | KSSQSLLHSDGRNYLY (SEQ ID NO: 118) | EVSNRFS (SEQ ID NO: 124) | MQSFPLPLT (SEQ ID NO: 132) |
| 69 | LV-123 | DIQMTQSPSSLSASVGDRVTITCRASQGIRKDLGWYQQKPGKAPKRLIYGASSLQSGVPSRFSGSGSGIEFTLTISSLQPEDFATYYCLQYNSFPWTFGQGTKVEIK (SEQ ID NO: 158) | RASQGIRKDLG (SEQ ID NO: 119) | GASSLQS (SEQ ID NO: 126) | LQYNSFPWT (SEQ ID NO: 135) |

TABLE 3B

Exemplary Anti-CGRP Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| 50A, 50C, 50D | HV-101 | EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYFCTTDRTGYSISWSSYYYYYGMDVWGQGTTVTVSS (SEQ ID NO: 190) | NAWMS (SEQ ID NO: 159) | RIKSKTDGGTTDYAAPVKG (SEQ ID NO: 167) | DRTGYSISWSSYYYYGMDV (SEQ ID NO: 179) |
| 50B | HV-102 | EVQLVESGGGLVKPGGSLRLSCAASGFTFGNAWMSWVRQAPGKELEWVGRIKSKTDGGTTDYAAPVKGRFTISRDDSKNTLYLQMNSLKTEDTAVYFCTTDRTGYSISWSSYYYYYGMDVWGQGTTVTVSS (SEQ ID NO: 191) | NAWMS (SEQ ID NO: 159) | RIKSKTDGGTTDYAAPVKG (SEQ ID NO: 167) | DRTGYSISWSSYYYYGMDV (SEQ ID NO: 179) |
| 51A, 51C, 51D | HV-103 | EVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSISWSSYYYYYGMDVWGQGTTVTVSS (SEQ ID NO: 192) | NAWMS (SEQ ID NO: 159) | RIKSKTDGGTTDYTAPVKG (SEQ ID NO: 168) | DRTGYSISWSSYYYYGMDV (SEQ ID NO: 179) |
| 51B | HV-104 | EVQLVESGGGLVKPGGSLRLSCAASGFTFSNAWMSWVRQAPGKELEWVGRIKSKTDGGTTDYTAPVKGRFTISRDDSKNTLYLQMNSLKAEDTAVYYCTTDRTGYSISWSSYYYYYGMDVWGQGTTVTVSS (SEQ ID NO: 193) | NAWMS (SEQ ID NO: 159) | RIKSKTDGGTTDYTAPVKG (SEQ ID NO: 168) | DRTGYSISWSSYYYYGMDV (SEQ ID NO: 179) |
| 52A, 52C, 52D, 54A, 54C, 55A, 55C, 59, 66 | HV-105 | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSS (SEQ ID NO: 194) | SFGMH (SEQ ID NO: 160) | VISFDGSIKYSVDSVKG (SEQ ID NO: 169) | DRLNYYDSSGYYHYKYYGMAV (SEQ ID NO: 180) |

TABLE 3B-continued

Exemplary Anti-CGRP Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| 52B, 54B, 55B | HV-106 | QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYDSSGYYHYKYYGMAVWGQGTTVTVSS (SEQ ID NO: 195) | SFGMH (SEQ ID NO: 160) | VISFDGSIKYSVDSVKG (SEQ ID NO: 169) | DRLNYYDSSGYYHYKYYGMAV (SEQ ID NO: 180) |
| 53A, 53C, 56A, 56C | HV-107 | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS (SEQ ID NO: 196) | SFGMH (SEQ ID NO: 160) | VISFDGSIKYSVDSVKG (SEQ ID NO: 169) | DRLNYYESSGYYHYKYYGMAV (SEQ ID NO: 181) |
| 53B, 56B | HV-108 | QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYESSGYYHYKYYGMAVWGQGTTVTVSS (SEQ ID NO: 197) | SFGMH (SEQ ID NO: 160) | VISFDGSIKYSVDSVKG (SEQ ID NO: 169) | DRLNYYESSGYYHYKYYGMAV (SEQ ID NO: 181) |
| 57A, 57C, 57D | HV-109 | QVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSS (SEQ ID NO: 198) | SYGMH (SEQ ID NO: 161) | VIWYDGSNKYYADSVKG (SEQ ID NO: 170) | AGGIAAAGLYYYYGMDV (SEQ ID NO: 182) |
| 57B | HV-110 | QVQLVESGGGVVQPGRSLRLSCAASGFTFSSYGMHWVRQAPGKELEWVAVIWYDGSNKYYADSVKGRFIISRDKSKNTLYLQMNSLRAEDTAVYYCARAGGIAAAGLYYYYGMDVWGQGTTVTVSS (SEQ ID NO: 199) | SYGMH (SEQ ID NO: 161) | VIWYDGSNKYYADSVKG (SEQ ID NO: 170) | AGGIAAAGLYYYYGMDV (SEQ ID NO: 182) |
| 58A, 58C | HV-111 | QVQLVESGGGVVQPGRSLRLSCAASGFTFSSYGMHWVRQAPGKGLEWVAVIWYDGSNKYYAESVKGRFIISRDKSKNTLYLQMNSLRAEDTAVYYCARAGGIAAAGLYYYYGMDVWGQGTTVTVSS (SEQ ID NO: 200) | SYGMH (SEQ ID NO: 161) | VIWYDGSNKYYAESVKG (SEQ ID NO: 171) | AGGIAAAGLYYYYGMDV (SEQ ID NO: 182) |
| 58B | HV-112 | QVQLVESGGGVVQPGRSLRLSCAASGFTFSSYGMHWVRQAPGKELEWVAVIWYDGSNKYYAESVKGRFIISRDKSKNTLYLQMNSLRAEDTAVYYCARAGGIAAAGLYYYYGMDVWGQGTTVTVSS (SEQ ID NO: 201) | SYGMH (SEQ ID NO: 161) | VIWYDGSNKYYAESVKG (SEQ ID NO: 171) | AGGIAAAGLYYYYGMDV (SEQ ID NO: 182) |
| 60 | HV-113 | EVQLVESGGGLVKPGGSLRLSCAASGFTFSNAWMSWVRQAPGKGLEWVGRIKSTTDGGTTDYAAPVKGRFTISRDDSKNTLYLQMNSLKTEDTAVYYCTTDRTGYSISWSSYYYYGMDVWGQGTTVTVSS (SEQ ID NO: 202) | NAWMS (SEQ ID NO: 159) | RIKSTTDGGTTDYAAPVKG (SEQ ID NO: 172) | DRTGYSISWSSYYYYGMDV (SEQ ID NO: 179) |
| 61 | HV-114 | EVQLLESGGGLVQPGESLRLSCAASGFTFSSYAMSWVRQAPGKGLEWVSAISGSGGRTYYADSVKGRFTISRDNSKNTLYLQMNSLRAEDTAVYYCAKDQREVGPYSSGWYDYYYGMDVWGQGTTVTVSS (SEQ ID NO: 203) | SYAMS (SEQ ID NO: 162) | AISGSGGRTYYADSVKG (SEQ ID NO: 173) | DQREVGPYSSGWYDYYYGMDV (SEQ ID NO: 183) |

TABLE 3B-continued

Exemplary Anti-CGRP Receptor Heavy Chain Variable Region Amino Acid Sequences

| Antibody ID. | VH Group | VH Amino Acid Sequence | CDRH1 | CDRH2 | CDRH3 |
|---|---|---|---|---|---|
| 62 | HV-115 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYFCARDQMSIIMLRGVFPPYYYGMDVWGQGTTVTVSS (SEQ ID NO: 204) | GYYMH (SEQ ID NO: 163) | WINPNSGGTNYAQKFQG (SEQ ID NO: 174) | DQMSIIMLRGVFPPYYYGMDV (SEQ ID NO: 184) |
| 63, 65, 68 | HV-116 | QVQLVESGGGVVQPGRSLRLSCAASGFTFSSYGMHWVRQAPGKGLEWVAVISYDGSHESYADSVKGRFTISRDISKNTLYLQMNSLRAEDTAVYFCARERKRVTMSTLYYYFYYGMDVWGQGTTVTVSS (SEQ ID NO: 205) | SYGMH (SEQ ID NO: 161) | VISYDGSHESYADSVKG (SEQ ID NO: 175) | ERKRVTMSTLYYYFYYGMDV (SEQ ID NO: 185) |
| 64 | HV-117 | EVQLVESGGGLVKPGRSLRLSCTASGFTFGDYAMSWFRQAPGKGLEWIGFIRSRAYGGTPEYAASVKGRFTISRDDSKTIAYLQMNSLKTEDTAVYFCARGRGIAARWDYWGQGTLVTVSS (SEQ ID NO: 206) | DYAMS (SEQ ID NO: 164) | FIRSRAYGGTPEYAASVKG (SEQ ID NO: 176) | GRGIAARWDY (SEQ ID NO: 186) |
| 67 | HV-118 | QVQLVQSGAEVKKPGASVKVSCKASGYTFTDYYMYWVRQAPGQGLEWMGWISPNSGGTNYAQKFQGRVTMTRDTSISTAYMELSRLRSDDTAVYYCVRGGYSGYAGLYSHYYGMDVWGQGTTVTVSS (SEQ ID NO: 207) | DYYMY (SEQ ID NO: 165) | WISPNSGGTNYAQKFQG (SEQ ID NO: 177) | GGYSGYAGLYSHYYGMDV (SEQ ID NO: 187) |
| 69 | HV-119 | EVQLVESGGGLVKPGGSLRLSCAASGYTFSTYSMNWVRQAPGKGLEWVSSISSSSSYRYYADSVKGRFTISRDNAKNSLYLQMSSLRAEDTAVYYCAREGVSGSSPYSISWYDYYYGMDVWGQGTTVTVSS (SEQ ID NO: 208) | TYSMN (SEQ ID NO: 166) | SISSSSSYRYYADSVKG (SEQ ID NO: 178) | EGVSGSSPYSISWYDYYYGMDV (SEQ ID NO: 188) |
| 70 | HV-120 | EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYYCTTDRTGYSISWSSYYYYGMDVWGQGTTVTVSS (SEQ ID NO: 209) | NAWMS (SEQ ID NO: 159) | RIKSKTDGGTTDYAAPVKG (SEQ ID NO: 167) | DRTGYSISWSSYYYYGMDV (SEQ ID NO: 179) |
| 71 | HV-121 | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGLAVWGQGTTVTVSS (SEQ ID NO: 210) | SFGMH (SEQ ID NO: 160) | VISFDGSIKYSVDSVKG (SEQ ID NO: 169) | DRLNYYDSSGYYHYKYYGLAV (SEQ ID NO: 189) |

The anti-CGRP receptor binding domain of the bispecific antigen binding proteins may comprise one or more of the CDRs presented in Table 3A (light chain CDRs; i.e. CDRLs) and Table 3B (heavy chain CDRs, i.e. CDRHs). For instance, in certain embodiments, the anti-CGRP receptor binding domain comprises one or more light chain CDRs selected from (i) a CDRL1 selected from SEQ ID NOs: 109 to 119, (ii) a CDRL2 selected from SEQ ID NOs: 14, 17, 18, 120 to 126, and (iii) a CDRL3 selected from SEQ ID NOs: 127 to 135, and (iv) a CDRL of (i), (ii) and (iii) that contains one or more, e.g., one, two, three, four or more amino acid substitutions (e.g., conservative amino acid substitutions), deletions or insertions of no more than five, four, three, two, or one amino acids. In these and other embodiments, the anti-CGRP receptor binding domain comprises one or more heavy chain CDRs selected from (i) a CDRH1 selected from SEQ ID NOs: 159 to 166, (ii) a CDRH2 selected from SEQ ID NOs: 167 to 178, and (iii) a CDRH3 selected from SEQ ID NOs: 179 to 189, and (iv) a CDRH of (i), (ii) and (iii) that contains one or more, e.g., one, two, three, four or more amino acid substitutions (e.g., conservative amino acid substitutions), deletions or insertions of no more than five, four, three, two, or one amino acids amino acids.

In certain embodiments, the anti-CGRP receptor binding domain may comprise 1, 2, 3, 4, 5, or 6 variant forms of the CDRs listed in Tables 3A and 3B, each having at least 80%, 85%, 90% or 95% sequence identity to a CDR sequence listed in Tables 3A and 3B. In some embodiments, the anti-CGRP receptor binding domain includes 1, 2, 3, 4, 5, or 6 of the CDRs listed in Tables 3A and 3B, each differing by no more than 1, 2, 3, 4 or 5 amino acids from the CDRs listed in these tables.

In particular embodiments, the anti-CGRP receptor binding domain of the bispecific antigen binding proteins of the invention comprises a light chain variable region comprising a CDRL1, a CDRL2, and a CDRL3, wherein: (a) CDRL1, CDRL2, and CDRL3 have the sequence of SEQ ID NOs: 109, 120 and 127, respectively; (b) CDRL1, CDRL2, and CDRL3 have the sequence of SEQ ID NOs: 110, 121 and 128, respectively; (c) CDRL1, CDRL2, and CDRL3 have the sequence of SEQ ID NOs: 111, 17 and 129, respectively; (d) CDRL1, CDRL2, and CDRL3 have the sequence of SEQ ID NOs: 109, 122 and 127, respectively; (e) CDRL1, CDRL2, and CDRL3 have the sequence of SEQ ID NOs: 112, 14 and 130, respectively; (f) CDRL1, CDRL2, and CDRL3 have the sequence of SEQ ID NOs: 113, 123 and 131, respectively; (g) CDRL1, CDRL2, and CDRL3 have the sequence of SEQ ID NOs: 114, 124 and 132, respectively; (h) CDRL1, CDRL2, and CDRL3 have the sequence of SEQ ID NOs: 115, 18 and 133, respectively; (i) CDRL1, CDRL2, and CDRL3 have the sequence of SEQ ID NOs: 116, 124 and 132, respectively; (j) CDRL1, CDRL2, and CDRL3 have the sequence of SEQ ID NOs: 117, 125 and 134, respectively; (k) CDRL1, CDRL2, and CDRL3 have the sequence of SEQ ID NOs: 118, 124 and 132, respectively; or (l) CDRL1, CDRL2, and CDRL3 have the sequence of SEQ ID NOs: 119, 126 and 135, respectively.

In other particular embodiments, the anti-CGRP receptor binding domain of the bispecific antigen binding proteins of the invention comprises a heavy chain variable region comprising a CDRH1, a CDRH2, and a CDRH3, wherein: (a) CDRH1, CDRH2, and CDRH3 have the sequence of SEQ ID NOs: 159, 167 and 179, respectively; (b) CDRH1, CDRH2, and CDRH3 have the sequence of SEQ ID NOs: 159, 168 and 179, respectively; (c) CDRH1, CDRH2, and CDRH3 have the sequence of SEQ ID NOs: 160, 169 and 180, respectively; (d) CDRH1, CDRH2, and CDRH3 have the sequence of SEQ ID NOs: 160, 169 and 181, respectively; (e) CDRH1, CDRH2, and CDRH3 have the sequence of SEQ ID NOs: 161, 170 and 182, respectively; (f) CDRH1, CDRH2, and CDRH3 have the sequence of SEQ ID NOs: 161, 171 and 182, respectively; (g) CDRH1, CDRH2, and CDRH3 have the sequence of SEQ ID NOs: 159, 172 and 179, respectively; (h) CDRH1, CDRH2, and CDRH3 have the sequence of SEQ ID NOs: 162, 173 and 183, respectively; (i) CDRH1, CDRH2, and CDRH3 have the sequence of SEQ ID NOs: 163, 174 and 184, respectively; (j) CDRH1, CDRH2, and CDRH3 have the sequence of SEQ ID NOs: 161, 175 and 185, respectively; (k) CDRH1, CDRH2, and CDRH3 have the sequence of SEQ ID NOs: 164, 176 and 186, respectively; (l) CDRH1, CDRH2, and CDRH3 have the sequence of SEQ ID NOs: 165, 177 and 187, respectively; (m) CDRH1, CDRH2, and CDRH3 have the sequence of SEQ ID NOs: 166, 178 and 188, respectively; or (n) CDRH1, CDRH2, and CDRH3 have the sequence of SEQ ID NOs: 160, 169 and 189, respectively.

In certain embodiments, the anti-CGRP receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 167 and 179, respectively;
(b) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 168 and 179, respectively;
(c) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 180, respectively;
(d) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 181, respectively;
(e) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 170 and 182, respectively;
(f) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 171 and 182, respectively;
(g) CDRL1, CDRL2, and CDRL3 have the sequence of SEQ ID NOs: 109, 122 and 127, respectively, and CDRH1, CDRH2, and CDRH3 have the sequence of SEQ ID NOs: 159, 172 and 179, respectively;
(h) CDRL1, CDRL2, and CDRL3 have the sequence of SEQ ID NOs: 112, 14 and 130, respectively, and CDRH1, CDRH2, and CDRH3 have the sequence of SEQ ID NOs: 162, 173 and 183, respectively;
(i) CDRL1, CDRL2, and CDRL3 have the sequence of SEQ ID NOs: 113, 123 and 131, respectively, and CDRH1, CDRH2, and CDRH3 have the sequence of SEQ ID NOs: 163, 174 and 184, respectively;
(j) CDRL1, CDRL2, and CDRL3 have the sequence of SEQ ID NOs: 114, 124 and 132, respectively, and CDRH1, CDRH2, and CDRH3 have the sequence of SEQ ID NOs: 161, 175 and 185, respectively;
(k) CDRL1, CDRL2, and CDRL3 have the sequence of SEQ ID NOs: 115, 18 and 133, respectively, and CDRH1, CDRH2, and CDRH3 have the sequence of SEQ ID NOs: 164, 176 and 186, respectively;
(l) CDRL1, CDRL2, and CDRL3 have the sequence of SEQ ID NOs: 116, 124 and 132, respectively, and CDRH1, CDRH2, and CDRH3 have the sequence of SEQ ID NOs: 161, 175 and 185, respectively;
(m) CDRL1, CDRL2, and CDRL3 have the sequence of SEQ ID NOs: 117, 125 and 134, respectively, and CDRH1, CDRH2, and CDRH3 have the sequence of SEQ ID NOs: 165, 177 and 187, respectively;
(n) CDRL1, CDRL2, and CDRL3 have the sequence of SEQ ID NOs: 118, 124 and 132, respectively, and CDRH1, CDRH2, and CDRH3 have the sequence of SEQ ID NOs: 161, 175 and 185, respectively;
(o) CDRL1, CDRL2, and CDRL3 have the sequence of SEQ ID NOs: 119, 126 and 135, respectively, and CDRH1, CDRH2, and CDRH3 have the sequence of SEQ ID NOs: 166, 178 and 188, respectively; or
(p) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 189, respectively.

In some embodiments, the anti-CGRP receptor binding domain of the bispecific antigen binding proteins of the invention comprises a light chain variable region comprising a CDRL1, a CDRL2, and a CDRL3 and a heavy chain variable region comprising a CDRH1, a CDRH2, and a CDRH3, wherein:

(a) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 167 and 179, respectively;

(b) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 168 and 179, respectively;

(c) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 180, respectively;

(d) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 181, respectively;

(e) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 170 and 182, respectively; or (f) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 171 and 182, respectively.

The anti-CGRP receptor binding domain of the antigen binding proteins of the invention may comprise a light chain variable region selected from the group consisting of LV-101, LV-102, LV-103, LV-104, LV-105, LV-106, LV-107, LV-108, LV-109, LV-110, LV-111, LV-112, LV-113, LV-114, LV-115, LV-116, LV-117, LV-118, LV-119, LV-120, LV-121, LV-122, and LV-123, as shown in Table 3A, and/or a heavy chain variable region selected from the group consisting of HV-101, HV-102, HV-103, HV-104, HV-105, HV-106, HV-107, HV-108, HV-109, HV-110, HV-111, HV-112, HV-113, HV-114, HV-115, HV-116, HV-117, HV-118, HV-119, HV-120, and HV-121, as shown in Table 3B, and functional fragments, derivatives, muteins and variants of these light chain and heavy chain variable regions.

Each of the light chain variable regions listed in Table 3A may be combined with any of the heavy chain variable regions shown in Table 3B to form an anti-CGRP receptor binding domain suitable for incorporation into the bispecific antigen binding proteins of the invention. Examples of such combinations include, but are not limited to: LV-101 and HV-101; LV-102 and HV-102; LV-103 and HV-103; LV-104 and HV-104; LV-105 and HV-105; LV-106 and HV-106; LV-105 and HV-107; LV-106 and HV-108; LV-107 and HV-105; LV-108 and HV-106; LV-109 and HV-105; LV-110 and HV-106; LV-107 and HV-107; LV-108 and HV-108; LV-111 and HV-109; LV-112 and HV-110; LV-111 and HV-111; LV-112 and HV-112; LV-113 and HV-105; LV-114 and HV-113; LV-115 and HV-114; LV-116 and HV-115; LV-117 and HV-116; LV-118 and HV-117; LV-119 and HV-116; LV-120 and HV-105; LV-121 and HV-118; LV-122 and HV-116; LV-123 and HV-119; LV-101 and HV-120; and LV-107 and HV-121. In certain embodiments, the anti-CGRP receptor binding domain comprises: (a) LV-101 (SEQ ID NO: 136) and HV-101 (SEQ ID NO: 190); (b) LV-103 (SEQ ID NO: 138) and HV-103 (SEQ ID NO: 192); (c) LV-105 (SEQ ID NO: 140) and HV-105 (SEQ ID NO: 194); (d) LV-105 (SEQ ID NO: 140) and HV-107 (SEQ ID NO: 196); (e) LV-107 (SEQ ID NO: 142) and HV-105 (SEQ ID NO: 194); (f) LV-109 (SEQ ID NO: 144) and HV-105 (SEQ ID NO: 194); (g) LV-107 (SEQ ID NO: 142) and HV-107 (SEQ ID NO: 196); (h) LV-111 (SEQ ID NO: 146) and HV-109 (SEQ ID NO: 198); or (i) LV-111 (SEQ ID NO: 146) and HV-111 (SEQ ID NO: 200).

In some embodiments, the anti-CGRP receptor binding domain comprises a light chain variable region comprising a sequence of contiguous amino acids that differs from the sequence of a light chain variable region in Table 3A, i.e. a VL selected from LV-101, LV-102, LV-103, LV-104, LV-105, LV-106, LV-107, LV-108, LV-109, LV-110, LV-111, LV-112, LV-113, LV-114, LV-115, LV-116, LV-117, LV-118, LV-119, LV-120, LV-121, LV-122, and LV-123 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some anti-CGRP binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 136-158 (i.e. the light chain variable regions in Table 3A).

In these and other embodiments, the anti-CGRP receptor binding domain comprises a heavy chain variable region comprising a sequence of contiguous amino acids that differs from the sequence of a heavy chain variable region in Table 3B, i.e., a VH selected from HV-101, HV-102, HV-103, HV-104, HV-105, HV-106, HV-107, HV-108, HV-109, HV-110, HV-111, HV-112, HV-113, HV-114, HV-115, HV-116, HV-117, HV-118, HV-119, HV-120, and HV-121 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some anti-CGRP receptor binding domains comprises a sequence of amino acids that has at least 70%, at least 75%, at least 80%, at least 85%, at least 90%, at least 95%, at least 97% or at least 99% sequence identity to the amino acid sequences of SEQ ID NOs: 190-210 (i.e. the heavy chain variable regions in Table 3B).

In certain embodiments, the bispecific antigen binding proteins of the invention are antibodies. As used herein, the term "antibody" refers to a tetrameric immunoglobulin protein comprising two light chain polypeptides (about 25 kDa each) and two heavy chain polypeptides (about 50-70 kDa each). The term "light chain" or "immunoglobulin light chain" refers to a polypeptide comprising, from amino terminus to carboxyl terminus, a single immunoglobulin light chain variable region (VL) and a single immunoglobulin light chain constant domain (CL). The immunoglobulin light chain constant domain (CL) can be kappa (κ) or lambda (λ). The term "heavy chain" or "immunoglobulin heavy chain" refers to a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4). Heavy chains are classified as mu (μ), delta (Δ), gamma (γ), alpha (α), and epsilon (ε), and define the antibody's isotype as IgM, IgD, IgG, IgA, and IgE, respectively. The IgG-class and IgA-class antibodies are further divided into subclasses, namely, IgG1, IgG2, IgG3, and IgG4, and IgA1 and IgA2, respectively. The heavy chains in IgG, IgA, and IgD antibodies have three domains (CH1, CH2, and CH3), whereas the heavy chains in IgM and IgE antibodies have four domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (i.e. between the light and heavy chain) and between the hinge regions of the antibody heavy chains.

In particular embodiments, the bispecific antigen binding proteins of the invention are heterodimeric antibodies (used interchangeably herein with "hetero immunoglobulins" or "hetero Igs"), which refer to antibodies comprising two different light chains and two different heavy chains. For instance, in some embodiments, the heterodimeric antibody comprises a light chain and heavy chain from an anti-PAC1 receptor antibody and a light chain and heavy chain from an anti-CGRP receptor antibody. See FIG. 1.

The heterodimeric antibodies can comprise any immunoglobulin constant region. The term "constant region" as used herein refers to all domains of an antibody other than the variable region. The constant region is not involved directly in binding of an antigen, but exhibits various effector functions. As described above, antibodies are divided into particular isotypes (IgA, IgD, IgE, IgG, and IgM) and subtypes (IgG1, IgG2, IgG3, IgG4, IgA1 IgA2) depending on the amino acid sequence of the constant region of their heavy chains. The light chain constant region can be, for example, a kappa- or lambda-type light chain constant region, e.g., a human kappa- or lambda-type light chain constant region, which are found in all five antibody isotypes. Examples of human immunoglobulin light chain constant region sequences are shown in the following table.

TABLE 4

Exemplary Human Immunoglobulin Light Chain Constant Regions

| Designation | SEQ ID NO: | CL Domain Amino Acid Sequence |
| --- | --- | --- |
| CL-1 | 353 | GQPKANPTVTLFPPSSEELQANKATLVCLISDFYPGAVTVAWKADGSPVKAG VETTKPSKQSNNKYAASSYLSLTPEQWKSHRSYSCQVTHEGSTVEKTVAPFEC S |
| CL-2 | 354 | GQPKAAPSVTLFPPSSEELQANKATLVCLISDFYPGAVTVAWKADSSPVKAGV ETTTPSKQSNNKYAASSYLSLTPEQWKSHRSYSCQVTHEGSTVEKTVAPTECS |
| CL-3 | 355 | GQPKAAPSVTLFPPSSEELQANKATLVCLISDFYPGAVTVAWKADSSPVKAGV ETTTPSKQSNNKYAASSYLSLTPEQWKSHKSYSCQVTHEGSTVEKTVAPTECS |
| CL-7 | 356 | GQPKAAPSVTLFPPSSEELQANKATLVCLVSDFYPGAVTVAWKADGSPVKVG VETTKPSKQSNNKYAASSYLSLTPEQWKSHRSYSCRVTHEGSTVEKTVAPAEC S |

The heavy chain constant region of the heterodimeric antibodies can be, for example, an alpha-, delta-, epsilon-, gamma-, or mu-type heavy chain constant region, e.g., a human alpha-, delta-, epsilon-, gamma-, or mu-type heavy chain constant region. In some embodiments, the heterodimeric antibodies comprise a heavy chain constant region from an IgG1, IgG2, IgG3, or IgG4 immunoglobulin. In one embodiment, the heterodimeric antibody comprises a heavy chain constant region from a human IgG1 immunoglobulin. In another embodiment, the heterodimeric antibody comprises a heavy chain constant region from a human IgG2 immunoglobulin.

Examples of human IgG1 and IgG2 heavy chain constant region sequences are shown below in Table 5.

TABLE 5

Exemplary Human Immunoglobulin Heavy Chain Constant Regions

| Ig isotype | SEQ ID NO: | Heavy Chain Constant Region Amino Acid Sequence |
| --- | --- | --- |
| Human IgG1z | 357 | ASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVH NAKTKPREEQYNSTYRVVSVLTVLHQDWLNGKEYKCKVSNKALPAPIEKTISKAK GQPREPQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPGK |
| Human IgG1za | 358 | ASTKGPSVFPLAPSSKSTSGGTAALGCLVKDYFPEPVTVSWNSGALTSGVHTFPAV LQSSGLYSLSSVVTVPSSSLGTQTYICNVNHKPSNTKVDKKVEPKSCDKTHTCPPCP |

TABLE 5-continued

Exemplary Human Immunoglobulin Heavy Chain Constant Regions

| Ig isotype | SEQ ID NO: | Heavy Chain Constant Region Amino Acid Sequence |
|---|---|---|
| | | APELLGGPSVFLFPPKPKDTLMISRTPEVTCVVVDVSHEDPEVKFNWYVDGVEVH<br>NAKTKPREEQYNSTYRVVSVLTVLHQDWLNGKEYKCKVSNKALPAPIEKTISKAK<br>GQPREPQVYTLPPSRDELTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| Human IgG1f | 359 | ASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKRVEPKSCDKTHTCPPCP<br>APELLGGPSVFLFPPKPKDTLMISRTPEVTCVVVDVSHEDPEVKFNWYVDGVEVH<br>NAKTKPREEQYNSTYRVVSVLTVLHQDWLNGKEYKCKVSNKALPAPIEKTISKAK<br>GQPREPQVYTLPPSREEMTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| Human IgG1fa | 360 | ASTKGPSVFPLAPSSKSTSGGTAALGCLVKDYFPEPVTVSWNSGALTSGVHTFPAV<br>LQSSGLYSLSSVVTVPSSSLGTQTYICNVNHKPSNTKVDKRVEPKSCDKTHTCPPCP<br>APELLGGPSVFLFPPKPKDTLMISRTPEVTCVVVDVSHEDPEVKFNWYVDGVEVH<br>NAKTKPREEQYNSTYRVVSVLTVLHQDWLNGKEYKCKVSNKALPAPIEKTISKAK<br>GQPREPQVYTLPPSRDELTKNQVSLTCLVKGFYPSDIAVEWESNGQPENNYKTTPP<br>VLDSDGSFFLYSKLTVDKSRWQQGNVFSCSVMHEALHNHYTQKSLSLSPGK |
| Human IgG2 | 361 | ASTKGPSVFPLAPCSRSTSESTAALGCLVKDYFPEPVTVSWNSGALTSGVHTFPAV<br>LQSSGLYSLSSVVTVPSSNFGTQTYTCNVDHKPSNTKVDKTVERKCCVECPPCPAP<br>PVAGPSVFLFPPKPKDTLMISRTPEVTCVVVDVSHEDPEVQFNWYVDGVEVHNAK<br>TKPREEQFNSTFRVVSVLTVVHQDWLNGKEYKCKVSNKGLPAPIEKTISKTKGQPR<br>EPQVYTLPPSREEMTKNQVSLTCLVKGFYPSDIAVEWESNGQPENNYKTTPPMLDS<br>DGSFFLYSKLTVDKSRWQQGNVFSCSVMHEALHNHYTQKSLSLSPGK |

Each of the variable regions disclosed in Tables 1A, 1B, 3A, and 3B may be attached to the above light and heavy chain constant regions to form complete antibody light and heavy chains, respectively. Further, each of the so generated heavy and light chain polypeptides may be combined to form a complete bispecific antibody structure, e.g. a heterodimeric antibody. It should be understood that the heavy chain and light chain variable regions provided herein can also be attached to other constant domains having different sequences than the exemplary sequences listed above.

To facilitate assembly of the light and heavy chains from the anti-PAC1 receptor antibody and the light and heavy chains from the anti-CGRP receptor antibody into a bispecific, heterodimeric antibody, the light chains and/or heavy chains from each antibody can be engineered to reduce the formation of mispaired molecules. For example, one approach to promote heterodimer formation over homodimer formation is the so-called "knobs-into-holes" method, which involves introducing mutations into the CH3 domains of two different antibody heavy chains at the contact interface. Specifically, one or more bulky amino acids in one heavy chain are replaced with amino acids having short side chains (e.g. alanine or threonine) to create a "hole," whereas one or more amino acids with large side chains (e.g. tyrosine or tryptophan) are introduced into the other heavy chain to create a "knob." When the modified heavy chains are co-expressed, a greater percentage of heterodimers (knob-hole) are formed as compared to homodimers (hole-hole or knob-knob). The "knobs-into-holes" methodology is described in detail in WO 96/027011; Ridgway et al., Protein Eng., Vol. 9: 617-621, 1996; and Merchant et al., Nat, Biotechnol., Vol. 16: 677-681, 1998, all of which are hereby incorporated by reference in their entireties.

Another approach for promoting heterodimer formation to the exclusion of homodimer formation entails utilizing an electrostatic steering mechanism (see Gunasekaran et al., J. Biol. Chem., Vol. 285: 19637-19646, 2010, which is hereby incorporated by reference in its entirety). This approach involves introducing or exploiting charged residues in the CH3 domain in each heavy chain so that the two different heavy chains associate through opposite charges that cause electrostatic attraction. Homodimerization of the identical heavy chains are disfavored because the identical heavy chains have the same charge and therefore are repelled. This same electrostatic steering technique can be used to prevent mispairing of light chains with the non-cognate heavy chains by introducing residues having opposite charges in the correct light chain-heavy chain pair at the binding interface. The electrostatic steering technique and suitable charge pair mutations for promoting heterodimers and correct light chain/heavy chain pairing is described in WO2009089004 and WO2014081955, both of which are hereby incorporated by reference in their entireties.

In embodiments in which the bispecific antigen binding proteins of the invention are heterodimeric antibodies comprising a first light chain (LC1) and first heavy chain (HC1) from a first antibody that specifically binds to human CGRP receptor and a second light chain (LC2) and second heavy chain (HC2) from a second antibody that specifically binds to human PAC1 receptor, HC1 or HC2 may comprise one or more amino acid substitutions to replace a positively-charged amino acid with a negatively-charged amino acid. For instance, in one embodiment, the CH3 domain of HC1 or the CH3 domain of HC2 comprises an amino acid sequence differing from a wild-type IgG amino acid sequence such that one or more positively-charged amino acids (e.g., lysine, histidine and arginine) in the wild-type human IgG amino acid sequence are replaced with one or more negatively-charged amino acids (e.g., aspartic acid and glutamic acid) at the corresponding position(s) in the CH3 domain. In these and other embodiments, amino acids (e.g. lysine) at one or more positions selected from 370, 392 and 409 (EU numbering system) are replaced with a negatively-charged amino acid (e.g., aspartic acid and glutamic acid). Unless indicated otherwise, throughout the present specification and claims, the numbering of the residues in an immunoglobulin heavy chain or light chain is according to Kabat-EU numbering as described in Kabat et al., Sequences of Proteins of Immunological Interest, 5th Ed. Public Health Service, National Institutes of Health, Bethesda, Md. (1991). An amino acid substitution in an amino acid sequence is typically designated herein with a one-letter abbreviation for the amino acid residue in a particular position, followed by the numerical amino acid position relative to an original sequence of interest, which is then followed by the one-letter symbol for the amino acid residue substituted in. For example, "T30D" symbolizes a substitution of a threonine residue by an aspartate residue at amino acid position 30, relative to the original sequence of interest. Another example, "S218G" symbolizes a substitution of a serine residue by a glycine residue at amino acid position 218, relative to the original amino acid sequence of interest.

In certain embodiments, HC1 or HC2 of the heterodimeric antibodies may comprise one or more amino acid substitutions to replace a negatively-charged amino acid with a positively-charged amino acid. For instance, in one embodiment, the CH3 domain of HC1 or the CH3 domain of HC2 comprises an amino acid sequence differing from wild-type IgG amino acid sequence such that one or more negatively-charged amino acids in the wild-type human IgG amino acid sequence are replaced with one or more positively-charged amino acids at the corresponding position(s) in the CH3 domain. In these and other embodiments, amino acids (e.g., aspartic acid or glutamic acid) at one or more positions selected from 356, 357, and 399 (EU numbering system) of the CH3 domain are replaced with a positively-charged amino acid (e.g., lysine, histidine and arginine).

In particular embodiments, the heterodimeric antibody comprises a first heavy chain comprising negatively-charged amino acids at positions 392 and 409 (e.g., K392D and K409D substitutions), and a second heavy chain comprising positively-charged amino acids at positions 356 and 399 (e.g., E356K and D399K substitutions). In other particular embodiments, the heterodimeric antibody comprises a first heavy chain comprising negatively-charged amino acids at positions 392, 409, and 370 (e.g., K392D, K409D, and K370D substitutions), and a second heavy chain comprising positively-charged amino acids at positions 356, 399, and 357 (e.g., E356K, D399K, and E357K substitutions). In related embodiments, the first heavy chain is from an anti-CGRP receptor antibody and the second heavy chain is from an anti-PAC1 receptor antibody. In other related embodiments, the first heavy chain is from an anti-PAC1 receptor antibody and the second heavy chain is from an anti-CGRP receptor antibody.

To facilitate the association of a particular heavy chain with its cognate light chain, both the heavy and light chains may contain complimentary amino acid substitutions. As used herein, "complimentary amino acid substitutions" refer to a substitution to a positively-charged amino acid in one chain paired with a negatively-charged amino acid substitution in the other chain.

For example, in some embodiments, the heavy chain comprises at least one amino acid substitution to introduce a charged amino acid and the corresponding light chain comprises at least one amino acid substitution to introduce a charged amino acid, wherein the charged amino acid introduced into the heavy chain has the opposite charge of the amino acid introduced into the light chain. In certain embodiments, one or more positively-charged residues (e.g., lysine, histidine or arginine) can be introduced into a first light chain (LC1) and one or more negatively-charged residues (e.g., aspartic acid or glutamic acid) can be introduced into the companion heavy chain (HC1) at the binding interface of LC1/HC1, whereas one or more negatively-charged residues (e.g., aspartic acid or glutamic acid) can be introduced into a second light chain (LC2) and one or more positively-charged residues (e.g., lysine, histidine or arginine) can be introduced into the companion heavy chain (HC2) at the binding interface of LC2/HC2. The electrostatic interactions will direct the LC1 to pair with HC1 and LC2 to pair with HC2, as the opposite charged residues (polarity) at the interface attract. The heavy/light chain pairs having the same charged residues (polarity) at an interface (e.g. LC1/HC2 and LC2/HC1) will repel, resulting in suppression of the unwanted HC/LC pairings.

In these and other embodiments, the CH1 domain of the heavy chain or the CL domain of the light chain comprises an amino acid sequence differing from wild-type IgG amino acid sequence such that one or more positively-charged amino acids in wild-type IgG amino acid sequence is replaced with one or more negatively-charged amino acids. Alternatively, the CH1 domain of the heavy chain or the CL domain of the light chain comprises an amino acid sequence differing from wild-type IgG amino acid sequence such that one or more negatively-charged amino acids in wild-type IgG amino acid sequence is replaced with one or more positively-charged amino acids. In some embodiments, one or more amino acids in the CH1 domain of the first and/or second heavy chain in the heterodimeric antibody at an EU position selected from F126, P127, L128, A141, L145, K147, D148, H168, F170, P171, V173, Q175, S176, S183, V185 and K213 is replaced with a charged amino acid. In certain embodiments, a preferred residue for substitution with a negatively- or positively-charged amino acid is S183 (EU numbering system). In some embodiments, S183 is substituted with a positively-charged amino acid. In alternative embodiments, S183 is substituted with a negatively-charged amino acid. For instance, in one embodiment, S183 is substituted with a negatively-charged amino acid (e.g. S183E) in the first heavy chain, and S183 is substituted with a positively-charged amino acid (e.g. S183K) in the second heavy chain.

In embodiments in which the light chain is a kappa light chain, one or more amino acids in the CL domain of the first and/or second light chain in the heterodimeric antibody at a position (EU and Kabat numbering in a kappa light chain) selected from F116, F118, S121, D122, E123, Q124, S131, V133, L135, N137, N138, Q160, S162, T164, S174 and S176 is replaced with a charged amino acid. In embodiments in which the light chain is a lambda light chain, one or more amino acids in the CL domain of the first and/or second light chain in the heterodimeric antibody at a position (Kabat numbering in a lambda chain) selected from T116, F118, S121, E123, E124, K129, T131, V133, L135, S137, E160, T162, S165, Q167, A174, S176 and Y178 is replaced with a charged amino acid. In some embodiments, a preferred residue for substitution with a negatively- or positively-charged amino acid is S176 (EU and Kabat numbering system) of the CL domain of either a kappa or lambda light chain. In certain embodiments, S176 of the CL domain is replaced with a positively-charged amino acid. In alternative embodiments, S176 of the CL domain is replaced with a negatively-charged amino acid. In one embodiment, S176 is substituted with a positively-charged amino acid (e.g. S176K) in the first light chain, and S176 is substituted with a negatively-charged amino acid (e.g. S176E) in the second light chain.

In addition to or as an alternative to the complimentary amino acid substitutions in the CH1 and CL domains, the variable regions of the light and heavy chains in the heterodimeric antibody may contain one or more complimentary amino acid substitutions to introduce charged amino acids. For instance, in some embodiments, the VH region of the heavy chain or the VL region of the light chain of a heterodimeric antibody comprises an amino acid sequence differing from wild-type IgG amino acid sequence such that one or more positively-charged amino acids in wild-type IgG amino acid sequence is replaced with one or more negatively-charged amino acids. Alternatively, the VH region of the heavy chain or the VL region of the light chain comprises an amino acid sequence differing from wild-type IgG amino acid sequence such that one or more negatively-charged amino acids in wild-type IgG amino acid sequence is replaced with one or more positively-charged amino acids.

V region interface residues (i.e., amino acid residues that mediate assembly of the VH and VL regions) within the VH region include Kabat positions 1, 3, 35, 37, 39, 43, 44, 45, 46, 47, 50, 59, 89, 91, and 93. One or more of these interface residues in the VH region can be substituted with a charged (positively- or negatively-charged) amino acid. In certain embodiments, the amino acid at Kabat position 39 in the VH region of the first and/or second heavy chain is substituted for a positively-charged amino acid, e.g., lysine. In alternative embodiments, the amino acid at Kabat position 39 in the VH region of the first and/or second heavy chain is substituted for a negatively-charged amino acid, e.g., glutamic acid. In some embodiments, the amino acid at Kabat position 39 in the VH region of the first heavy chain is substituted for a negatively-charged amino acid (e.g. G39E), and the amino acid at Kabat position 39 in the VH region of the second heavy chain is substituted for a positively-charged amino acid (e.g. G39K). In some embodiments, the amino acid at Kabat position 44 in the VH region of the first and/or second heavy chain is substituted for a positively-charged amino acid, e.g., lysine. In alternative embodiments, the amino acid at Kabat position 44 in the VH region of the first and/or second heavy chain is substituted for a negatively-charged amino acid, e.g., glutamic acid. In certain embodiments, the amino acid at Kabat position 44 in the VH region of the first heavy chain is substituted for a negatively-charged amino acid (e.g. G44E), and the amino acid at Kabat position 44 in the VH region of the second heavy chain is substituted for a positively-charged amino acid (e.g. G44K).

V region interface residues (i.e., amino acid residues that mediate assembly of the VH and VL regions) within the VL region include Kabat positions 32, 34, 35, 36, 38, 41, 42, 43, 44, 45, 46, 48, 49, 50, 51, 53, 54, 55, 56, 57, 58, 85, 87, 89, 90, 91, and 100. One or more interface residues in the VL region can be substituted with a charged amino acid, preferably an amino acid that has an opposite charge to those introduced into the VH region of the cognate heavy chain. In some embodiments, the amino acid at Kabat position 100 in the VL region of the first and/or second light chain is substituted for a positively-charged amino acid, e.g., lysine. In alternative embodiments, the amino acid at Kabat position 100 in the VL region of the first and/or second light chain is substituted for a negative-charged amino acid, e.g., glutamic acid. In certain embodiments, the amino acid at Kabat position 100 in the VL region of the first light chain is substituted for a positively-charged amino acid (e.g. G100K), and the amino acid at Kabat position 100 in the VL region of the second light chain is substituted for a negatively-charged amino acid (e.g. G100E).

In certain embodiments, a heterodimeric antibody of the invention comprises a first heavy chain and a second heavy chain and a first light chain and a second light chain, wherein the first heavy chain comprises amino acid substitutions at positions 44 (Kabat), 183 (EU), 392 (EU) and 409 (EU), wherein the second heavy chain comprises amino acid substitutions at positions 44 (Kabat), 183 (EU), 356 (EU) and 399 (EU), wherein the first and second light chains comprise an amino acid substitution at positions 100 (Kabat) and 176 (EU), and wherein the amino acid substitutions introduce a charged amino acid at said positions. In related embodiments, the glycine at position 44 (Kabat) of the first heavy chain is replaced with glutamic acid, the glycine at position 44 (Kabat) of the second heavy chain is replaced with lysine, the glycine at position 100 (Kabat) of the first light chain is replaced with lysine, the glycine at position 100 (Kabat) of the second light chain is replaced with glutamic acid, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the serine at position 183 (EU) of the second heavy chain is replaced with lysine, the glutamic acid at position 356 (EU) of the second heavy chain is replaced with lysine, and/or the aspartic acid at position 399 (EU) of the second heavy chain is replaced with lysine.

In other embodiments, a heterodimeric antibody of the invention comprises a first heavy chain and a second heavy chain and a first light chain and a second light chain, wherein the first heavy chain comprises amino acid substitutions at positions 183 (EU), 392 (EU) and 409 (EU), wherein the second heavy chain comprises amino acid substitutions at positions 183 (EU), 356 (EU) and 399 (EU), wherein the first and second light chains comprise an amino acid substitution at position 176 (EU), and wherein the amino acid substitutions introduce a charged amino acid at said positions. In related embodiments, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the serine at position 183 (EU) of the second heavy chain is replaced with lysine, the glutamic acid at position 356 (EU) of the second heavy chain is replaced with lysine, and/or the aspartic acid at position 399 (EU) of the second heavy chain is replaced with lysine.

In still other embodiments, a heterodimeric antibody of the invention comprises a first heavy chain and a second heavy chain and a first light chain and a second light chain, wherein the first heavy chain comprises amino acid substitutions at positions 183 (EU), 392 (EU), 409 (EU), and 370 (EU), wherein the second heavy chain comprises amino acid substitutions at positions 183 (EU), 356 (EU), 399 (EU), and 357 (EU), wherein the first and second light chains comprise an amino acid substitution at position 176 (EU), and wherein the amino acid substitutions introduce a charged amino acid at said positions. In related embodiments, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the lysine at position 370 (EU) of the first heavy chain is replaced with aspartic acid, the serine at position 183 (EU)

of the second heavy chain is replaced with lysine, the glutamic acid at position 356 (EU) of the second heavy chain is replaced with lysine, the aspartic acid at position 399 (EU) of the second heavy chain is replaced with lysine, and/or the glutamic acid at position 357 (EU) of the second heavy chain is replaced with lysine.

Any of the constant domains, anti-PAC1 receptor variable regions, and anti-CGRP receptor variable regions described herein can be modified to contain one or more of the charge pair mutations described above to facilitate correct assembly of a heterodimeric antibody.

Exemplary full-length light chain sequences and full-length heavy chain sequences from anti-PAC1 receptor antibodies containing one or more charge pair mutations suitable for use in the heterodimeric antibodies of the invention are shown in Table 6A and Table 6B, respectively.

TABLE 6A

Exemplary Anti-PAC1 Receptor Light Chain Sequences

| Antibody ID. | LC Group | Light Chain Amino Acid Sequence | Light Chain Nucleic Acid Sequence |
|---|---|---|---|
| 01A, 01C, 01D | LC-01 | DIQMTQSPSSLSASVGDRITITCRAGACATCCAGATGACCCAGTCTCCATCCTCCC SQSISRYLNWYQQKPGKAPKLLIY TGTCTGCATCTGTAGGAGACAGAATCACCA AASSLQSGIPSRFSGSGSGTDFTLTTCACTTGCCGGGCAAGTCAGAGCATTAGCA INSLQPEDFATYFCQQSYSPPFTGGGTATTTAAATTGGTATCAACAGAAACCAG PGTKVDIKRTVAAPSVFIFPPSDEQGGAAAGCCCCTAAACTCCTGATCTATGCTG LKSGTASVVCLLNNFYPREAKVQ CATCCAGTTTGCAAAGTGGGATCCCATCAA WKVDNALQSGNSQESVTEQDSK GGTTCAGCGGCAGTGGATCTGGGACAGATT DSTYSLESTLTLSKADYEKHKVY TCACTCTCACCATCAACAGTCTGCAACCTGA ACEVTHQGLSSPVTKSFNRGEC AGATTTTGCAACTTACTTCTGTCAACAGAGT (SEQ ID NO: 211) TACAGTCCCCCATTCACTTTCGGCCCTGGGA CCAAAGTGGATATCAAACGTACGGTGGCTG CACCATCTGTCTTCATCTTCCCGCCATCTGA TGAGCAGTTGAAATCTGGAACTGCCTCTGTT GTGTGCCTGCTGAATAACTTCTATCCCAGAG AGGCCAAAGTACAGTGGAAGGTGGATAAC GCCCTCCAATCGGGTAACTCCCAGGAGAGT GTCACAGAGCAGGACAGCAAGGACAGCAC CTACAGCCTCGAGAGCACCCTGACGCTGAG CAAAGCAGACTACGAGAAACACAAAGTCTA CGCCTGCGAAGTCACCCATCAGGGCCTGAG CTCGCCCGTCACAAAGAGCTTCAACAGGGG AGAGTGT (SEQ ID NO: 222) |
| 01B | LC-02 | DIQMTQSPSSLSASVGDRITITCRAGACATCCAGATGACCCAGTCTCCATCCTCCC SQSISRYLNWYQQKPGKAPKLLIY TGTCTGCATCTGTAGGAGACAGAATCACCA AASSLQSGIPSRFSGSGSGTDFTLTTCACTTGCCGGGCAAGTCAGAGCATTAGCA INSLQPEDFATYFCQQSYSPPFTGGGTATTTAAATTGGTATCAACAGAAACCAG EGTKVDIKRTVAAPSVFIFPPSDE GGAAAGCCCCTAAACTCCTGATCTATGCTG QLKSGTASVVCLLNNFYPREAKV CATCCAGTTTGCAAAGTGGGATCCCATCAA QWKVDNALQSGNSQESVTEQDS GGTTCAGCGGCAGTGGATCTGGGACAGATT KDSTYSLESTLTLSKADYEKHKV TCACTCTCACCATCAACAGTCTGCAACCTGA YACEVTHQGLSSPVTKSFNRGEC AGATTTTGCAACTTACTTCTGTCAACAGAGT (SEQ ID NO: 212) TACAGTCCCCCATTCACTTTCGGCGAGGGG ACCAAAGTGGATATCAAACGTACGGTGGCT GCACCATCTGTCTTCATCTTCCCGCCATCTG ATGAGCAGTTGAAATCTGGAACTGCCTCTG TTGTGTGCCTGCTGAATAACTTCTATCCCAG AGAGGCCAAAGTACAGTGGAAGGTGGATA ACGCCCTCCAATCGGGTAACTCCCAGGAGA GTGTCACAGAGCAGGACAGCAAGGACAGC ACCTACAGCCTCGAGAGCACCCTGACGCTG AGCAAAGCAGACTACGAGAAACACAAAGT CTACGCCTGCGAAGTCACCCATCAGGGCCT GAGCTCGCCCGTCACAAAGAGCTTCAACAG GGGAGAGTGT (SEQ ID NO: 223) |
| 02A, 02C | LC-03 | DIQMTQSPSSLSASVGDRITITCRAGACATCCAGATGACCCAGTCTCCATCCTCCC SQSISRYLNWYQQKPGKAPKLLIY TGTCTGCATCTGTAGGAGACAGAATCACCA AASSLQSGIPSRFSGSGSGTDFTLTTCACTTGCCGGGCAAGTCAGAGCATTAGCA INSLQPEDFATYFCQQSYSPPFTGGGTATTTAAATTGGTATCAACAGAAACCAG QGTKVDIKRTVAAPSVFIFPPSDE GGAAAGCCCCTAAACTCCTGATCTATGCTG QLKSGTASVVCLLNNFYPREAKV CATCCAGTTTGCAAAGTGGGATCCCATCAA QWKVDNALQSGNSQESVTEQDS GGTTCAGCGGCAGTGGATCTGGGACAGATT KDSTYSLESTLTLSKADYEKHKV TCACTCTCACCATCAACAGTCTGCAACCTGA YACEVTHQGLSSPVTKSFNRGEC AGATTTTGCAACTTACTTCTGTCAACAGAGT (SEQ ID NO: 213) TACAGTCCCCCATTCACTTTCGGCCAGGGG ACCAAAGTGGATATCAAACGTACGGTGGCT GCACCATCTGTCTTCATCTTCCCGCCATCTG ATGAGCAGTTGAAATCTGGAACTGCCTCTG TTGTGTGCCTGCTGAATAACTTCTATCCCAG AGAGGCCAAAGTACAGTGGAAGGTGGATA ACGCCCTCCAATCGGGTAACTCCCAGGAGA |

TABLE 6A-continued

Exemplary Anti-PAC1 Receptor Light Chain Sequences

| Antibody ID. | LC Group | Light Chain Amino Acid Sequence | Light Chain Nucleic Acid Sequence |
|---|---|---|---|
| | | | GTGTCACAGAGCAGGACAGCAAGGACAGC ACCTACAGCCTCGAAAGCACCCTGACGCTG AGCAAAGCAGACTACGAGAAACACAAAGT CTACGCCTGCGAAGTCACCCATCAGGGCCT GAGCTCGCCCGTCACAAAGAGCTTCAACAG GGGAGAGTGT (SEQ ID NO: 224) |
| 03A, 03C, 03D | LC-04 | DIQLTQSPSFLSASVGDRVTITCRAGATATCCAGCTCACTCAATCGCCATCATTTC SQSIGRSLHWYQQKPGKAPKLLIK YASQSLSGVPSRFSGSGSGTEFTL TISSLQPEDFATYYCHQSSRLPFTFGGTCGTTGCATTGGTATCAGCAGAAACCCG GPGTKVDIKRTVAAPSVFIFPPSDEGAAAGGCCCCGAAACTTCTGATCAAATACG QLKSGTASVVCLLNNFYPREAKV QWKVDNALQSGNSQESVTEQDS KDSTYSLESTLTLSKADYEKHKV YACEVTHQGLSSPVTKSFNRGEC (SEQ ID NO: 214) | TCTCCGCTTCGGTAGGCGACCGGGTCACGA TCACATGCAGGGCGTCGCAAAGCATTGGGA YASQSLSGVPSRFSGSGSGTEFTL TCACATGCAGGGCGTCGCAAAGCATTGGGA TISSLQPEDFATYYCHQSSRLPFTFGGTCGTTGCATTGGTATCAGCAGAAACCCG CATCACAAAGCTTGAGCGGTGTGCCGTCGC GCTTCTCCGGTTCCGGAAGCGGAACGGAAT TCACGCTTACAATCTCCTCACTGCAGCCCGA GGATTTCGCGACCTATTACTGTCACCAGTCA TCCAGACTCCCGTTTACTTTTGGCCCTGGGA CCAAGGTGGACATTAAGCGTACGGTGGCTG CACCATCTGTCTTCATCTTCCCGCCATCTGA TGAGCAGTTGAAATCTGGAACTGCCTCTGTT GTGTGCCTGCTGAATAACTTCTATCCCAGAG AGGCCAAAGTACAGTGGAAGGTGGATAAC GCCCTCCAATCGGGTAACTCCCAGGAGAGT GTCACAGAGCAGGACAGCAAGGACAGCAC CTACAGCCTCGAGAGCACCCTGACGCTGAG CAAAGCAGACTACGAGAAACACAAAGTCTA CGCCTGCGAAGTCACCCATCAGGGCCTGAG CTCGCCCGTCACAAAGAGCTTCAACAGGGG AGAGTGT (SEQ ID NO: 225) |
| 03B | LC-05 | DIQLTQSPSFLSASVGDRVTITCRAGATATCCAGCTCACTCAATCGCCATCATTTC SQSIGRSLHWYQQKPGKAPKLLIK YASQSLSGVPSRFSGSGSGTEFTL TISSLQPEDFATYYCHQSSRLPFTFGGTCGTTGCATTGGTATCAGCAGAAACCCG GEGTKVDIKRTVAAPSVFIFPPSD EQLKSGTASVVCLLNNFYPREAK VQWKVDNALQSGNSQESVTEQD SKDSTYSLESTLTLSKADYEKHK VYACEVTHQGLSSPVTKSFNRGE C (SEQ ID NO: 215) | TCTCCGCTTCGGTAGGCGACCGGGTCACGA TCACATGCAGGGCGTCGCAAAGCATTGGGA TISSLQPEDFATYYCHQSSRLPFTFGGTCGTTGCATTGGTATCAGCAGAAACCCG GAAAGGCCCCGAAACTTCTGATCAAATACG CATCACAAAGCTTGAGCGGTGTGCCGTCGC GCTTCTCCGGTTCCGGAAGCGGAACGGAAT TCACGCTTACAATCTCCTCACTGCAGCCCGA GGATTTCGCGACCTATTACTGTCACCAGTCA TCCAGACTCCCGTTTACTTTTGGCGAGGGGA CCAAGGTGGACATTAAGCGTACGGTGGCTG CACCATCTGTCTTCATCTTCCCGCCATCTGA TGAGCAGTTGAAATCTGGAACTGCCTCTGTT GTGTGCCTGCTGAATAACTTCTATCCCAGAG AGGCCAAAGTACAGTGGAAGGTGGATAAC GCCCTCCAATCGGGTAACTCCCAGGAGAGT GTCACAGAGCAGGACAGCAAGGACAGCAC CTACAGCCTCGAGAGCACCCTGACGCTGAG CAAAGCAGACTACGAGAAACACAAAGTCTA CGCCTGCGAAGTCACCCATCAGGGCCTGAG CTCGCCCGTCACAAAGAGCTTCAACAGGGG AGAGTGT (SEQ ID NO: 226) |
| 04A, 04C, 04D | LC-06 | EIVLTQSPATLSLSPGERATLSCRAGAGATCGTACTTACTCAGTCACCCGCCACA SQSVGRSLHWYQQKPGQAPRLLI KYASQSLSGIPARFSGSGSGTDFT LTISSLEPEDFAVYYCHQSSRLPFTCGATCATTGCACTGGTACCAACAAAAACCG FGPGTKVDIKRTVAAPSVFIFPPSDGGCCAGGCCCCCAGACTTCTGATCAAGTAT EQLKSGTASVVCLLNNFYPREAK VQWKVDNALQSGNSQESVTEQD SKDSTYSLESTLTLSKADYEKHK VYACEVTHQGLSSPVTKSFNRGE C (SEQ ID NO: 216) | TTGTCCCTGAGCCCGGGTGAACGGGCGACC CTCAGCTGCCGAGCATCCCAGTCCGTCGGA KYASQSLSGIPARFSGSGSGTDFT CTCAGCTGCCGAGCATCCCAGTCCGTCGGA LTISSLEPEDFAVYYCHQSSRLPFTCGATCATTGCACTGGTACCAACAAAAACCG FGPGTKVDIKRTVAAPSVFIFPPSDGGCCAGGCCCCCAGACTTCTGATCAAGTAT GCGTCACAGAGCTTGTCGGGTATTCCCGCTC GCTTTTCGGGGTCGGGATCCGGACAGATT TCACGCTCACAATCTCCTCGCTGGAACCCG AGGACTTCGCGGTCTACTATTGTCATCAGTC ATCGAGGTTGCCTTTCACGTTTGGACCAGG GACCAAGGTGGACATTAAGCGTACGGTGGC TGCACCATCTGTCTTCATCTTCCCGCCATCT GATGAGCAGTTGAAATCTGGAACTGCCTCT GTTGTGTGCCTGCTGAATAACTTCTATCCCA GAGAGGCCAAAGTACAGTGGAAGGTGGAT AACGCCCTCCAATCGGGTAACTCCCAGGAG AGTGTCACAGAGCAGGACAGCAAGGACAG CACCTACAGCCTCGAGAGCACCCTGACGCT GAGCAAAGCAGACTACGAGAAACACAAAG TCTACGCCTGCGAAGTCACCCATCAGGGCC TGAGCTCGCCCGTCACAAAGAGCTTCAACA GGGGAGAGTGT (SEQ ID NO: 227) |

TABLE 6A-continued

Exemplary Anti-PAC1 Receptor Light Chain Sequences

| Antibody ID. | LC Group | Light Chain Amino Acid Sequence | Light Chain Nucleic Acid Sequence |
|---|---|---|---|
| 04B | LC-07 | EIVLTQSPATLSLSPGERATLSCRAGA SQSVGRSLHWYQQKPGQAPRLLI KYASQSLSGIPARFSGSGSGTDFT LTISSLEPEDFAVYYCHQSSRLPFT FGEGTKVDIKRTVAAPSVFIFPPSDG EQLKSGTASVVCLLNNFYPREAK VQWKVDNALQSGNSQESVTEQD SKDSTYSLESTLTLSKADYEKHK VYACEVTHQGLSSPVTKSFNRGE C (SEQ ID NO: 217) | GCGTCACAGAGCTTGTCGGGTATTCCCGCTC<br>(abbreviated; SEQ ID NO: 228) |
| 05A, 05C, 05D | LC-08 | DIVMTQSPDSLAVSLGERATIHCK SSQSVLYSSNNKNFLTWYQQKPG QPPKLLIYRASTRESGVPDRFSGS GSGTDFTLTISSLQAEDVAVYFCQ QYYSAPFTFGPGTRVDIKRTVAAP SVFIFPPSDEQLKSGTASVVCLLN NFYPREAKVQWKVDNALQSGNS QESV1EQDSKDSTYSLESTLTLSK ADYEKHKVYACEVTHQGLSSPVT KSFNRGEC (SEQ ID NO: 218) | GACATCGTGATGACCCAGTCTCCAGACTCC<br>(abbreviated; SEQ ID NO: 229) |
| 05B | LC-09 | DIVMTQSPDSLAVSLGERATIHCK SSQSVLYSSNNKNFLTWYQQKPG QPPKLLIYRASTRESGVPDRFSGS GSGTDFTLTISSLQAEDVAVYFCQ QYYSAPFTFGEGTRVDIKRTVAAP SVFIFPPSDEQLKSGTASVVCLLN NFYPREAKVQWKVDNALQSGNS QESVTEQDSKDSTYSLESTLTLSK ADYEKHKVYACEVTHQGLSSPVT KSFNRGEC (SEQ ID NO: 219) | GACATCGTGATGACCCAGTCTCCAGACTCC<br>(abbreviated; SEQ ID NO: 230) |
| 06A, 06C | LC-10 | DIVMTQSPDSLAVSLGERATINCK SSQSVLYSSNNKNFLTWYQQKPG QPPKLLIYRASTRESGVPDRFSGS | GACATCGTGATGACCCAGTCTCCAGACTCC CTGGCTGTGTCTCTGGGCGAGAGGGCCACC ATCAACTGCAAGTCCAGCCAGAGTGTTTTA |

TABLE 6A-continued

Exemplary Anti-PAC1 Receptor Light Chain Sequences

| Antibody ID. | LC Group | Light Chain Amino Acid Sequence | Light Chain Nucleic Acid Sequence |
|---|---|---|---|
| | | GSGTDFTLTISSLQAEDVAVYFCQ QYYSAPFTFGPGTRVDIKRTVAAP SVFIFPPSDEQLKSGTASVVCLLN NFYPREAKVQWKVDNALQSGNS QESVTEQDSKDSTYSLESTLTLSK ADYEKHKVYACEVTHQGLSSPVT KSFNRGEC (SEQ ID NO: 220) | TACAGCTCCAACAATAAGAACTTCTTAACTT GGTACCAGCAGAAACCAGGACAGCCTCCTA AACTTCTCATTTACCGGGCATCTACCCGGGA ATCCGGGGTTCCTGACCGATTCAGTGGCAG CGGGTCTGGGACAGATTTCACTCTCACCATC AGCAGCCTGCAGGCTGAAGATGTGGCAGTT TATTTCTGTCAGCAATATTATAGTGCTCCAT TCACTTTCGGCCCTGGGACCAGAGTGGATA TCAAACGTACGGTGGCTGCACCATCTGTCTT CATCTTCCCGCCATCTGATGAGCAGTTGAA ATCTGGAACTGCCTCTGTTGTGTGCCTGCTG AATAACTTCTATCCCAGAGAGGCCAAAGTA CAGTGGAAGGTGGATAACGCCCTCCAATCG GGTAACTCCCAGGAGAGTGTCACAGAGCAG GACAGCAAGGACAGCACCTACAGCCTCGAA AGCACCCTGACGCTGAGCAAAGCAGACTAC GAGAAACACAAAGTCTACGCCTGCGAAGTC ACCCATCAGGGCCTGAGCTCGCCCGTCACA AAGAGCTTCAACAGGGGAGAGTGT (SEQ ID NO: 231) |
| 06B | LC-11 | DIVMTQSPDSLAVSLGERATINCK SSQSVLYSSNNKNFLTWYQQKPG QPPKLLIYRASTRESGVPDRFSGS GSGTDFTLTISSLQAEDVAVYFCQ QYYSAPFTFGEGTRVDIKRTVAAP SVFIFPPSDEQLKSGTASVVCLLN NFYPREAKVQWKVDNALQSGNS QESVTEQDSKDSTYSLESTLTLSK ADYEKHKVYACEVTHQGLSSPVT KSFNRGEC (SEQ ID NO: 221) | GACATCGTGATGACCCAGTCTCCAGACTCC CTGGCTGTGTCTCTGGGCGAGAGGGCCACC ATCAACTGCAAGTCCAGCCAGAGTGTTTTA TACAGCTCCAACAATAAGAACTTCTTAACTT GGTACCAGCAGAAACCAGGACAGCCTCCTA AACTTCTCATTTACCGGGCATCTACCCGGGA ATCCGGGGTTCCTGACCGATTCAGTGGCAG CGGGTCTGGGACAGATTTCACTCTCACCATC AGCAGCCTGCAGGCTGAAGATGTGGCAGTT TATTTCTGTCAGCAATATTATAGTGCTCCAT TCACTTTCGGCGAGGGGACCAGAGTGGATA TCAAACGTACGGTGGCTGCACCATCTGTCTT CATCTTCCCGCCATCTGATGAGCAGTTGAA ATCTGGAACTGCCTCTGTTGTGTGCCTGCTG AATAACTTCTATCCCAGAGAGGCCAAAGTA CAGTGGAAGGTGGATAACGCCCTCCAATCG GGTAACTCCCAGGAGAGTGTCACAGAGCAG GACAGCAAGGACAGCACCTACAGCCTCGAA AGCACCCTGACGCTGAGCAAAGCAGACTAC GAGAAACACAAAGTCTACGCCTGCGAAGTC ACCCATCAGGGCCTGAGCTCGCCCGTCACA AAGAGCTTCAACAGGGGAGAGTGT (SEQ ID NO: 232) |

TABLE 6B

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| 01A, 02A | HC-01 | QVQLQQSGPGLVKPSQTL SLTCAISGDSVSSNSATW NWIRQSPSRGLEWLGRTY YRSKWSNHYAVSVKSRIT INPDTSKSQFSLQLNSVTP EDTAVYYCARGTWKQL WFLDHWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY | CAGGTACAGCTGCAGCAGTCAGGTCCAGGACTGGT GAAGCCCTCGCAGACCCTCTCACTCACCTGTGCCAT CTCCGGGGACAGTGTCTCTAGCAACAGTGCTACTTG GAACTGGATCAGGCAGTCCCCATCGAGAGGCCTTG AGTGGCTGGGAAGGACATATTACAGGTCCAAGTGG TCTAATCATTATGCAGTATCTGTGAAAAGTCGAATA ACCATCAACCCCGACACGTCCAAGAGCCAGTTCTCC CTGCAGCTGAACTCTGTGACTCCCGAGGACACGGCT GTGTATTACTGTGCAAGAGGAACGTGGAAACAGCT ATGGTTCCTTGACCACTGGGGCCAGGGAACCCTGGT CACCGTCTCTAGTGCCTCCACCAAGGGCCCATCGGT CTTCCCCCTGGCACCCTCCTCCAAGAGCACCTCTGG GGGCACAGCGGCCCTGGGCTGCCTGGTCAAGGACT ACTTCCCCGAACCGGTGACGGTGTCGTGGAACTCA GGCGCCCTGACCAGCGGCGTGCACACCTTCCCGGCT GTCCTACAGTCCTCAGGACTCTACTCCCTCAGCAGC GTGGTGACCGTGCCCTCCAGCAGCTTGGGCACCCA GACCTACATCTGCAACGTGAATCACAAGCCCAGCA ACACCAAGGTGGACAAGAAAGTTGAGCCCAAATCT TGTGACAAAACTCACACATGCCCACCGTGCCCAGC |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 233) | ACCTGAACTCCTGGGGGGACCGTCAGTCTTCCTCTT CCCCCCAAAACCCAAGGACACCCTCATGATCTCCCG GACCCCTGAGGTCACATGCGTGGTGGTGGACGTGA GCCACGAAGACCCTGAGGTCAAGTTCAACTGGTAC GTGGACGGCGTGGAGGTGCATAATGCCAAGACAAA GCCGTGTGAGGAGCAGTACGGCAGCACGTACCGTT GTGTCAGCGTCCTCACCGTCCTGCACCAGGACTGGC TGAATGGCAAGGAGTACAAGTGCAAGGTCTCCAAC AAAGCCCTCCCAGCCCCCATCGAGAAAACCATCTC CAAAGCCAAAGGGCAGCCCCGAGAACCACAGGTGT ACACCCTGCCCCCATCCCGGGAGGAGATGACCAAG AACCAGGTCAGCCTGACCTGCCTGGTCAAAGGCTTC TATCCCAGCGACATCGCCGTGGAGTGGGAGAGCAA TGGGCAGCCGGAGAACAACTACGATACCACGCCTC CCGTGCTGGACTCCGACGGCTCCTTCTTCCTCTATA GCGATCTCACCGTGGACAAGAGCAGGTGGCAGCAG GGGAACGTCTTCTCATGCTCCGTGATGCATGAGGCT CTGCACAACCACTACACGCAGAAGAGCCTCTCCCT GTCTCCGGGTAAA (SEQ ID NO: 252) |
| 01B | HC-02 | QVQLQQSGPGLVKPSQTL SLTCAISGDSVSSNSATW NWIRQSPSRKLEWLGRTY YRSKWSNHYAVSVKSRIT INPDTSKSQFSLQLNSVTP EDTAVYYCARGTWKQL WFLDHWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 234) | CAGGTACAGCTGCAGCAGTCAGGTCCAGGACTGGT GAAGCCCTCGCAGACCCTCTCACTCACCTGTGCCAT CTCCGGGGACAGTGTCTCTAGCAACAGTGCTACTTG GAACTGGATCAGGCAGTCCCCATCGAGAAAGCTTG AGTGGCTGGGAAGGACATATTACAGGTCCAAGTGG TCTAATCATTATGCAGTATCTGTGAAAAGTCGAATA ACCATCAACCCCGACACGTCCAAGAGCCAGTTCTCC CTGCAGCTGAACTCTGTGACTCCCGAGGACACGGCT GTGTATTACTGTGCAAGAGGAACGTGGAAACAGCT ATGGTTCCTTGACCACTGGGGCCAGGGAACCCTGGT CACCGTCTCTAGTGCCTCCACCAAGGGCCCATCGGT CTTCCCCCTGGCACCCTCCTCCAAGAGCACCTCTGG GGGCACAGCGGCCCTGGGCTGCCTGGTCAAGGACT ACTTCCCCGAACCGGTGACGGTGTCGTGGAACTCA GGCGCCCTGACCAGCGGCGTGCACACCTTCCCGGCT GTCCTACAGTCCTCAGGACTCTACTCCCTCAAGAGC GTGGTGACCGTGCCCTCCAGCAGCTTGGGCACCCA GACCTACATCTGCAACGTGAATCACAAGCCCAGCA ACACCAAGGTGGACAAGAAAGTTGAGCCCAAATCT TGTGACAAAACTCACACATGCCCACCGTGCCCAGC ACCTGAACTCCTGGGGGGACCGTCAGTCTTCCTCTT CCCCCCAAAACCCAAGGACACCCTCATGATCTCCCG GACCCCTGAGGTCACATGCGTGGTGGTGGACGTGA GCCACGAAGACCCTGAGGTCAAGTTCAACTGGTAC GTGGACGGCGTGGAGGTGCATAATGCCAAGACAAA GCCGTGTGAGGAGCAGTACGGCAGCACGTACCGTT GTGTCAGCGTCCTCACCGTCCTGCACCAGGACTGGC TGAATGGCAAGGAGTACAAGTGCAAGGTCTCCAAC AAAGCCCTCCCAGCCCCCATCGAGAAAACCATCTC CAAAGCCAAAGGGCAGCCCCGAGAACCACAGGTGT ACACCCTGCCCCCATCCCGGGAGGAGATGACCAAG AACCAGGTCAGCCTGACCTGCCTGGTCAAAGGCTTC TATCCCAGCGACATCGCCGTGGAGTGGGAGAGCAA TGGGCAGCCGGAGAACAACTACGATACCACGCCTC CCGTGCTGGACTCCGACGGCTCCTTCTTCCTCTATA GCGATCTCACCGTGGACAAGAGCAGGTGGCAGCAG GGGAACGTCTTCTCATGCTCCGTGATGCATGAGGCT CTGCACAACCACTACACGCAGAAGAGCCTCTCCCT GTCTCCGGGTAAA (SEQ ID NO: 253) |
| 01C, 02C | HC-03 | QVQLQQSGPGLVKPSQTL SLTCAISGDSVSSNSATW NWIRQSPSRGLEWLGRTY YRSKWSNHYAVSVKSRIT INPDTSKSQFSLQLNSVTP EDTAVYYCARGTWKQL WFLDHWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV | CAGGTACAGCTGCAGCAGTCAGGTCCAGGACTGGT GAAGCCCTCGCAGACCCTCTCACTCACCTGTGCCAT CTCCGGGGACAGTGTCTCTAGCAACAGTGCTACTTG GAACTGGATCAGGCAGTCCCCATCGAGAGGCTTG AGTGGCTGGGAAGGACATATTACAGGTCCAAGTGG TCTAATCATTATGCAGTATCTGTGAAAAGTCGAATA ACCATCAACCCCGACACGTCCAAGAGCCAGTTCTCC CTGCAGCTGAACTCTGTGACTCCCGAGGACACGGCT GTGTATTACTGTGCAAGAGGAACGTGGAAACAGCT ATGGTTCCTTGACCACTGGGGCCAGGGAACCCTGGT CACCGTCTCTAGTGCCTCCACCAAGGGCCCATCGGT CTTCCCCCTGGCACCCTCCTCCAAGAGCACCTCTGG GGGCACAGCGGCCCTGGGCTGCCTGGTCAAGGACT ACTTCCCCGAACCGGTGACGGTGTCGTGGAACTCA GGCGCCCTGACCAGCGGCGTGCACACCTTCCCGGCT |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVDGFYPSDIAVEWESNG QPENNYDTTPPVLDSDGS FFLYSDLTVDKSRWQQG NVFSCSVMHEALHNHYT QKSLSLSPGK (SEQ ID NO: 235) | GTCCTACAGTCCTCAGGACTCTACTCCCTCAAGAGC GTGGTGACCGTGCCCTCCAGCAGCTTGGGCACCCA GACCTACATCTGCAACGTGAATCACAAGCCCAGCA ACACCAAGGTGGACAAGAAAGTTGAGCCCAAATCT TGTGACAAAACTCACACATGCCCACCGTGCCCAGC ACCTGAACTCCTGGGGGGACCGTCAGTCTTCCTCTT CCCCCCAAAACCCAAGGACACCCTCATGATCTCCCG GACCCCTGAGGTCACATGCGTGGTGGTGGACGTGA GCCACGAAGACCCTGAGGTCAAGTTCAACTGGTAC GTGGACGGCGTGGAGGTGCATAATGCCAAGACAAA GCCGTGTGAGGAGCAGTACGGCAGCACGTACCGTT GTGTCAGCGTCCTCACCGTCCTGCACCAGGACTGGC TGAATGGCAAGGAGTACAAGTGCAAGGTCTCCAAC AAAGCCCTCCCAGCCCCCATCGAGAAAACCATCTC CAAAGCCAAAGGGCAGCCCCGAGAACCACAGGTGT ACACCCTGCCCCCATCCCGGGAGGAGATGACCAAG AACCAGGTCAGCCTGACCTGCCTGGTCGATGGCTTC TATCCCAGCGACATCGCCGTGGAGTGGGAGAGCAA TGGGCAGCCGGAGAACAACTACGATACCACGCCTC CCGTGCTGGACTCCGACGGCTCCTTCTTCCTCTATA GCGATCTCACCGTGGACAAGAGCAGGTGGCAGCAG GGGAACGTCTTCTCATGCTCCGTGATGCATGAGGCT CTGCACAACCACTACACGCAGAAGAGCCTCTCCCT GTCTCCGGGTAAA (SEQ ID NO: 254) |
| 01D | HC-04 | QVQLQQSGPGLVKPSQTL SLTCAISGDSVSSNSATW NWIRQSPSRGLEWLGRTY YRSKWSNHYAVSVKSRIT INPDTSKSQFSLQLNSVTP EDTAVYYCARGTWKQL WFLDHWGQGTLVTVSSA STKGPSVFPLAPCSRSTSE STAALGCLVKDYFPEPVT VSWNSGALTSGVHTFPA VLQSSGLYSLKSVVTVPS SNFGTQTYTCNVDHKPSN TKVDKTVERKCCVECPPC PAPPVAGPSVFLFPPKPKD TLMISRTPEVTCVVVDVS HEDPEVQFNWYVDGVEV HNAKTKPREEQFNSTFRV VSVLTVVHQDWLNGKEY KCKVSNKGLPAPIEKTISK TKGQPREPQVYTLPPSRE EMTKNQVSLTCLVDGFY PSDIAVEWESNGQPENNY DTTPPMLDSDGSFFLYSD LTVDKSRWQQGNVFSCS VMHEALHNHYTQKSLSL SPGK (SEQ ID NO: 236) | CAGGTACAGCTGCAGCAGTCAGGTCCAGGACTGGT GAAGCCCTCGCAGACCCTCTCACTCACCTGTGCCAT CTCCGGGGACAGTGTCTCTAGCAACAGTGCTACTTG GAACTGGATCAGGCAGTCCCCATCGAGAGGCCTTG AGTGGCTGGGAAGGACATATTACAGGTCCAAGTGG TCTAATCATTATGCAGTATCTGTGAAAAGTCGAATA ACCATCAACCCCGACACGTCCAAGAGCCAGTTCTCC CTGCAGCTGAACTCTGTGACTCCCGAGGACACGGCT GTGTATTACTGTGCAAGAGGAACGTGGAAACAGCT ATGGTTCCTTGACCACTGGGGCCAGGGAACCCTGGT CACCGTCTCTAGTGCCTCCACCAAGGGCCCATCGGT CTTCCCCCTGGCGCCCTGCTCCAGGAGCACCTCCGA GAGCACAGCGGCCCTGGGCTGCCTGGTCAAGGACT ACTTCCCCGAACCGGTGACGGTGTCGTGGAACTCA GGCGCTCTGACCAGCGGCGTGCACACCTTCCCAGCT GTCCTACAGTCCTCAGGACTCTACTCCCTCAAGAGC GTGGTGACCGTGCCCTCCAGCAACTTCGGCACCCAG ACCTACACCTGCAACGTAGATCACAAGCCCAGCAA CACCAAGGTGGACAAGACAGTTGAGCGCAAATGTT GTGTCGAGTGCCCACCGTGCCCAGCACCACCTGTG CAGGACCGTCAGTCTTCCTCTTCCCCCCAAAACCCA AGGACACCCTCATGATCTCCCGGACCCCTGAGGTCA CGTGCGTGGTGGTGGACGTGAGCCACGAAGACCCC GAGGTCCAGTTCAACTGGTACGTGGACGGCGTGGA GGTGCATAATGCCAAGACAAAGCCACGGGAGGAGC AGTTCAACAGCACGTTCCGTGTGGTCAGCGTCCTCA CCGTTGTGCACCAGGACTGGCTGAACGGCAAGGAG TACAAGTGCAAGGTCTCCAACAAAGGCCTCCCAGC CCCCATCGAGAAAACCATCTCCAAAACCAAAGGGC AGCCCCGAGAACCACAGGTGTACACCCTGCCCCCA TCCCGGGAGGAGATGACCAAGAACCAGGTCAGCCT GACCTGCCTGGTCGATGGCTTCTACCCCAGCGACAT CGCCGTGGAGTGGGAGAGCAATGGGCAGCCGGAGA ACAACTACGATACCACACCTCCCATGCTGGACTCCG ACGGCTCCTTCTTCCTCTACAGCGATCTCACCGTGG ACAAGAGCAGGTGGCAGCAGGGGAACGTCTTCTCA TGCTCCGTGATGCATGAGGCTCTGCACAACCACTAC ACGCAGAAGAGCCTCTCCCTGTCTCCGGGTAAA (SEQ ID NO: 255) |
| 03A | HC-05 | QVQLVESGAEVVKPGAS VKVSCKASGFTFSRFAMH WVRQAPGQGLEWMGVIS YDGGNKYYAESVKGRVT MTRDTSTSTLYMELSSLR SEDTAVYYCARGYDVLT GYPDYWGQGTLVTVSSA STKGPSVFPLAPSSKSTSG GTAALGCLVKDYFPEPVT VSWNSGALTSGVHTFPA | CAAGTTCAGTTGGTGGAGTCTGGAGCCGAAGTAGT AAAGCCAGGAGCTTCAGTGAAAGTCTCTTGTAAAG CAAGTGGATTCACGTTTAGCCGCTTTGCCATGCATT GGGTGCGGCAAGCTCCCGGTCAGGGGTTGGAGTGG ATGGGAGTTATTAGCTATGACGGGGGCAATAAGTA CTACGCCGAGTCTGTTAAGGGTCGGGTCACAATGA CACGGGACACCTCAACCAGTACACTCTATATGGAA CTGTCTAGCCTGAGATCCGAGGACACCGCTGTGTAT TATTGCGCTAGGGGTACGATGTATTGACGGGTTAT CCTGATTACTGGGGCAGGGGACACTCGTAACCGT |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 237) | CTCTAGTGCCTCCACCAAGGGCCCATCGGTCTTCCC CCTGGCACCCTCCTCCAAGAGCACCTCTGGGGGCAC AGCGGCCCTGGGCTGCCTGGTCAAGGACTACTTCCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCAAAGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 256) |
| 03B | HC-06 | QVQLVESGAEVVKPGAS VKVSCKASGFTFSRFAMH WVRQAPGQKLEWMGVIS YDGGNKYYAESVKGRVT MTRDTSTSTLYMELSSLR SEDTAVYYCARGYDVLT GYPDYWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 238) | CAAGTTCAGTTGGTGGAGTCTGGAGCCGAAGTAGT AAAGCCAGGAGCTTCAGTGAAAGTCTCTTGTAAAG CAAGTGGATTCACGTTTAGCCGCTTTGCCATGCATT GGGTGCGGCAAGCTCCCGGTCAGAAGTTGGAGTGG ATGGGAGTTATTAGCTATGACGGGGGCAATAAGTA CTACGCCGAGTCTGTTAAGGGTCGGGTCACAATGA CACGGGACACCTCAACCAGTACACTCTATATGGAA CTGTCTAGCCTGAGATCCGAGGACACCGCTGTGTAT TATTGCGCTAGGGGGTACGATGTATTGACGGGTTAT CCTGATTACTGGGGCAGGGGACACTCGTAACCGT CTCTAGTGCCTCCACCAAGGGCCCATCGGTCTTCCC CCTGGCACCCTCCTCCAAGAGCACCTCTGGGGGCAC AGCGGCCCTGGGCTGCCTGGTCAAGGACTACTTCCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCAAAGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 257) |
| 03C | HC-07 | QVQLVESGAEVVKPGAS VKVSCKASGFTFSRFAMH WVRQAPGQGLEWMGVIS YDGGNKYYAESVKGRVT MTRDTSTSTLYMELSSLR | CAAGTTCAGTTGGTGGAGTCTGGAGCCGAAGTAGT AAAGCCAGGAGCTTCAGTGAAAGTCTCTTGTAAAG CAAGTGGATTCACGTTTAGCCGCTTTGCCATGCATT GGGTGCGGCAAGCTCCCGGTCAGGGGTTGGAGTGG ATGGGAGTTATTAGCTATGACGGGGGCAATAAGTA |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | SEDTAVYYCARGYDVLT GYPDYWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVDGFYPSDIAVEWESNG QPENNYDTTPPVLDSDGS FFLYSDLTVDKSRWQQG NVFSCSVMHEALHNHYT QKSLSLSPGK (SEQ ID NO: 239) | CTACGCCGAGTCTGTTAAGGGTCGGGTCACAATGA CACGGGACACCTCAACCAGTACACTCTATATGGAA CTGTCTAGCCTGAGATCCGAGGACACCGCTGTGTAT TATTGCGCTAGGGGGTACGATGTATTGACGGGTTAT CCTGATTACTGGGGGCAGGGGACACTCGTAACCGT CTCTAGTGCCTCCACCAAGGGCCCATCGGTCTTCCC CCTGGCACCCTCCTCCAAGAGCACCTCTGGGGGCAC AGCGGCCCTGGGCTGCCTGGTCAAGGACTACTTCCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCGATGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 258) |
| 03D | HC-08 | QVQLVESGAEVVKPGAS VKVSCKASGFTFSRFAMH WVRQAPGQGLEWMGVIS YDGGNKYYAESVKGRVT MTRDTSTSTLYMELSSLR SEDTAVYYCARGYDVLT GYPDYWGQGTLVTVSSA STKGPSVFPLAPCSRSTSE STAALGCLVKDYFPEPVT VSWNSGALTSGVHTFPA VLQSSGLYSLKSVVTVPS SNFGTQTYTCNVDHKPSN TKVDKTVERKCCVECPPC PAPPVAGPSVFLFPPKPKD TLMISRTPEVTCVVVDVS HEDPEVQFNWYVDGVEV HNAKTKPREEQFNSTFRV VSVLTVVHQDWLNGKEY KCKVSNKGLPAPIEKTISK TKGQPREPQVYTLPPSRE EMTKNQVSLTCLVDGFY PSDIAVEWESNGQPENNY DTTPPMLDSDGSFFLYSD LTVDKSRWQQGNVFSCS VMHEALHNHYTQKSLSL SPGK (SEQ ID NO: 240) | CAAGTTCAGTTGGTGGAGTCTGGAGCCGAAGTAGT AAAGCCAGGAGCTTCAGTGAAAGTCTCTTGTAAAG CAAGTGGATTCACGTTTAGCCGCTTTGCCATGCATT GGGTGCGGCAAGCTCCGGTCAGGGGTTGAGTGG ATGGGAGTTATTAGCTATGACGGGGGCAATAAGTA CTACGCCGAGTCTGTTAAGGGTCGGGTCACAATGA CACGGGACACCTCAACCAGTACACTCTATATGGAA CTGTCTAGCCTGAGATCCGAGGACACCGCTGTGTAT TATTGCGCTAGGGGGTACGATGTATTGACGGGTTAT CCTGATTACTGGGGGCAGGGGACACTCGTAACCGT CTCTAGTGCCTCCACCAAGGGCCCATCGGTCTTCCC CCTGGCGCCCTGCTCCAGGAGCACCTCCGAGAGCA CAGCGGCCCTGGGCTGCCTGGTCAAGGACTACTTCC CCGAACCGGTGACGGTGTCGTGGAACTCAGGCGCT CTGACCAGCGGCGTGCACACCTTCCCAGCTGTCCTA CAGTCCTCAGGACTCTACTCCCTCAAGAGCGTGGTG ACCGTGCCCTCCAGCAACTTCGGCACCCAGACCTAC ACCTGCAACGTAGATCACAAGCCCAGCAACACCAA GGTGGACAAGACAGTTGAGCGCAAATGTTGTGTCG AGTGCCCACCGTGCCCAGCACCACCTGTGGCAGGA CCGTCAGTCTTCCTCTTCCCCCCAAAACCCAAGGAC ACCCTCATGATCTCCCGGACCCCTGAGGTCACGTGC GTGGTGGTGGACGTGAGCCACGAAGACCCCGAGGT CCAGTTCAACTGGTACGTGGACGGCGTGGAGGTGC ATAATGCCAAGACAAAGCCACGGGAGGAGCAGTTC AACAGCACGTTCCGTGTGGTCAGCGTCCTCACCGTT GTGCACCAGGACTGGCTGAACGGCAAGGAGTACAA GTGCAAGGTCTCCAACAAAGGCCTCCCAGCCCCCA TCGAGAAAACCATCTCCAAAACCAAAGGGCAGCCC CGAGAACCACAGGTGTACACCCTGCCCCCATCCCG GGAGGAGATGACCAAGAACCAGGTCAGCCTGACCT GCCTGGTCGATGGCTTCTACCCCAGCGACATCGCCG TGGAGTGGGAGAGCAATGGGCAGCCGGAGAACAA CTACGATACCACACCTCCCATGCTGGACTCCGACGG CTCCTTCTTCCTCTACAGCGATCTCACCGTGGACAA GAGCAGGTGGCAGCAGGGGAACGTCTTCTCATGCT CCGTGATGCATGAGGCTCTGCACAACCACTACACG CAGAAGAGCCTCTCCCTGTCTCCGGGTAAA (SEQ ID NO: 259) |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| 04A | HC-09 | QVQLVESGGGVVQPGRS LRLSCAASGFTFSRFAMH WVRQAPGKGLEWVAVIS YDGGNKYYAESVKGRFT ISRDNSKNTLYLQMNSLR AEDTALFYCARGYDVLT GYPDYWGQGTLVTVSSA STKGPSVFPLAPSSKSTSG GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 241) | CAGGTGCAGCTGGTGGAGTCTGGGGGAGGCGTGGT CCAGCCTGGGAGGTCCCTGCGACTCTCCTGTGCAGC CTCTGGATTCACCTTCAGTAGATTTGCCATGCACTG GGTCCGCCAGGCTCCAGGCAAGGGGCTGGAGTGGG TGGCAGTTATATCATATGATGGAGGAAATAAATAC TATGCAGAGTCCGTGAAGGGCCGGTTCACCATCTCC AGAGACAATTCCAAGAACACCCTGTATCTGCAAAT GAACAGCCTGAGAGCTGAGGACACGGCTCTGTTTT ACTGTGCGAGAGGATACGATGTTTTGACTGGTTACC CCGACTACTGGGGCCAGGGAACCCTGGTCACCGTC TCTAGTGCCTCCACCAAGGGCCCATCGGTCTTCCCC CTGGCACCCTCCTCCAAGAGCACCTCTGGGGGCAC AGCGGCCCTGGGCTGCCTGGTCAAGGACTACTTCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCAAAGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 260) |
| 04B | HC-10 | QVQLVESGGGVVQPGRS LRLSCAASGFTFSRFAMH WVRQAPGKKLEWVAVIS YDGGNKYYAESVKGRFT ISRDNSKNTLYLQMNSLR AEDTALFYCARGYDVLT GYPDYWGQGTLVTVSSA STKGPSVFPLAPSSKSTS GTAALGCLVKDYFPEPVT VSWNSGALTSGVHTFPA VLQSSGLYSLKSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVKGFYPSDIAVEWESNG QPENNYDTTPPVLDSDGS FFLYSDLTVDKSRWQQG NVFSCSVMHEALHNHYT QKSLSLSPGK (SEQ ID NO: 242) | CAGGTGCAGCTGGTGGAGTCTGGGGGAGGCGTGGT CCAGCCTGGGAGGTCCCTGCGACTCTCCTGTGCAGC CTCTGGATTCACCTTCAGTAGATTTGCCATGCACTG GGTCCGCCAGGCTCCAGGCAAGAAGCTGGAGTGGG TGGCAGTTATATCATATGATGGAGGAAATAAATAC TATGCAGAGTCCGTGAAGGGCCGGTTCACCATCTCC AGAGACAATTCCAAGAACACCCTGTATCTGCAAAT GAACAGCCTGAGAGCTGAGGACACGGCTCTGTTTT ACTGTGCGAGAGGATACGATGTTTTGACTGGTTACC CCGACTACTGGGGCCAGGGAACCCTGGTCACCGTC TCTAGTGCCTCCACCAAGGGCCCATCGGTCTTCCCC CTGGCACCCTCCTCCAAGAGCACCTCTGGGGGCAC AGCGGCCCTGGGCTGCCTGGTCAAGGACTACTTCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCAAAGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | | CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 261) |
| 04C | HC-11 | QVQLVESGGGVVQPGRS LRLSCAASGFTFSRFAMH WVRQAPGKGLEWVAVIS YDGGNKYYAESVKGRFT ISRDNSKNTLYLQMNSLR AEDTALFYCARGYDVLT GYPDYWGQGTLVTVSSA STKGPSVFPLAPSSKSTSG GTAALGCLVKDYFPEPVT VSWNSGALTSGVHTFPA VLQSSGLYSLSSVVTVPS SSLGTQTYICNVNHKPSN TKVDKKVEPKSCDKTHT CPPCPAPELLGGPSVFLFP PKPKDTLMISRTPEVTCV VVDVSHEDPEVKFNWYV DGVEVHNAKTKPCEEQY GSTYRCVSVLTVLHQDW LNGKEYKCKVSNKALPA PIEKTISKAKGQPREPQVY TLPPSREEMTKNQVSLTC LVDGFYPSDIAVEWESNG QPENNYDTTPPVLDSDGS FFLYSDLTVDKSRWQQG NVFSCSVMHEALHNHYT QKSLSLSPGK (SEQ ID NO: 243) | CAGGTGCAGCTGGTGGAGTCTGGGGGAGGCGTGGT CCAGCCTGGGAGGTCCCTGCGACTCTCCTGTGCAGC CTCTGGATTCACCTTCAGTAGATTTGCCATGCACTG GGTCCGCCAGGCTCCAGGCAAGGGGCTGGAGTGGG TGGCAGTTATATCATATGATGGAGGAAATAAATAC TATGCAGAGTCCGTGAAGGGCCGGTTCACCATCTCC AGAGACAATTCCAAGAACACCCTGTATCTGCAAAT GAACAGCCTGAGAGCTGAGGACACGGCTCTGTTTT ACTGTGCGAGAGGATACGATGTTTTGACTGGTTACC CCGACTACTGGGGCCAGGGAACCCTGGTCACCGTC TCTAGTGCCTCCACCAAGGGCCCATCGGTCTTCCCC CTGGCACCCTCCTCCAAGAGCACCTCTGGGGGCAC AGCGGCCCTGGGCTGCCTGGTCAAGGACTACTTCC CGAACCGGTGACGGTGTCGTGGAACTCAGGCGCCC TGACCAGCGGCGTGCACACCTTCCCGGCTGTCCTAC AGTCCTCAGGACTCTACTCCCTCAAGAGCGTGGTGA CCGTGCCCTCCAGCAGCTTGGGCACCCAGACCTACA TCTGCAACGTGAATCACAAGCCCAGCAACACCAAG GTGGACAAGAAAGTTGAGCCCAAATCTTGTGACAA AACTCACACATGCCCACCGTGCCCAGCACCTGAACT CCTGGGGGGACCGTCAGTCTTCCTCTTCCCCCCAAA ACCCAAGGACACCCTCATGATCTCCCGGACCCCTGA GGTCACATGCGTGGTGGTGGACGTGAGCCACGAAG ACCCTGAGGTCAAGTTCAACTGGTACGTGGACGGC GTGGAGGTGCATAATGCCAAGACAAAGCCGTGTGA GGAGCAGTACGGCAGCACGTACCGTTGTGTCAGCG TCCTCACCGTCCTGCACCAGGACTGGCTGAATGGCA AGGAGTACAAGTGCAAGGTCTCCAACAAAGCCCTC CCAGCCCCCATCGAGAAAACCATCTCCAAAGCCAA AGGGCAGCCCCGAGAACCACAGGTGTACACCCTGC CCCCATCCCGGGAGGAGATGACCAAGAACCAGGTC AGCCTGACCTGCCTGGTCGATGGCTTCTATCCCAGC GACATCGCCGTGGAGTGGGAGAGCAATGGGCAGCC GGAGAACAACTACGATACCACGCCTCCCGTGCTGG ACTCCGACGGCTCCTTCTTCCTCTATAGCGATCTCA CCGTGGACAAGAGCAGGTGGCAGCAGGGGAACGTC TTCTCATGCTCCGTGATGCATGAGGCTCTGCACAAC CACTACACGCAGAAGAGCCTCTCCCTGTCTCCGGGT AAA (SEQ ID NO: 262) |
| 04D | HC-12 | QVQLVESGGGVVQPGRS LRLSCAASGFTFSRFAMH WVRQAPGKGLEWVAVIS YDGGNKYYAESVKGRFT ISRDNSKNTLYLQMNSLR AEDTALFYCARGYDVLT GYPDYWGQGTLVTVSSA STKGPSVFPLAPCSRSTSE STAALGCLVKDYFPEPVT VSWNSGALTSGVHTFPA VLQSSGLYSLSSVVTVPS SNFGTQTYTCNVDHKPSN TKVDKTVERKCCVECPPC PAPPVAGPSVFLFPPKPKD TLMISRTPEVTCVVVDVS HEDPEVQFNWYVDGVEV HNAKTKPREEQFNSTFRV VSVLTVVHQDWLNGKEY KCKVSNKGLPAPIEKTISK TKGQPREPQVYTLPPSRE EMTKNQVSLTCLVDGFY PSDIAVEWESNGQPENNY DTTPPMLDSDGSFFLYSD LTVDKSRWQQGNVFSCS VMHEALHNHYTQKSLSL SPGK (SEQ ID NO: 244) | CAGGTGCAGCTGGTGGAGTCTGGGGGAGGCGTGGT CCAGCCTGGGAGGTCCCTGCGACTCTCCTGTGCAGC CTCTGGATTCACCTTCAGTAGATTTGCCATGCACTG GGTCCGCCAGGCTCCAGGCAAGGGGCTGGAGTGGG TGGCAGTTATATCATATGATGGAGGAAATAAATAC TATGCAGAGTCCGTGAAGGGCCGGTTCACCATCTCC AGAGACAATTCCAAGAACACCCTGTATCTGCAAAT GAACAGCCTGAGAGCTGAGGACACGGCTCTGTTTT ACTGTGCGAGAGGATACGATGTTTTGACTGGTTACC CCGACTACTGGGGCCAGGGAACCCTGGTCACCGTC TCTAGTGCCTCCACCAAGGGCCCATCGGTCTTCCCC CTGGCGCCCTGCTCCAGGAGCACCTCCGAGAGCAC AGCGGCCCTGGGCTGCCTGGTCAAGGACTACTTCC CGAACCGGTGACGGTGTCGTGGAACTCAGGCGCTC TGACCAGCGGCGTGCACACCTTCCCAGCTGTCCTAC AGTCCTCAGGACTCTACTCCCTCAAGAGCGTGGTGA CCGTGCCCTCCAGCAACTTCGGCACCCAGACCTACA CCTGCAACGTAGATCACAAGCCCAGCAACACCAAG GTGGACAAGACAGTTGAGCGCAAATGTTGTGTCGA GTGCCCACCGTGCCCAGCACCACCTGTGGCAGGAC CGTCAGTCTTCCTCTTCCCCCCAAAACCCAAGGACA CCCTCATGATCTCCCGGACCCCTGAGGTCACGTGCG TGGTGGTGGACGTGAGCCACGAAGACCCCGAGGTC CAGTTCAACTGGTACGTGGACGGCGTGGAGGTGCA TAATGCCAAGACAAAGCCACGGGAGGAGCAGTTCA ACAGCACGTTCCGTGTGGTCAGCGTCCTCACCGTTG TGCACCAGGACTGGCTGAACGGCAAGGAGTACAAG TGCAAGGTCTCCAACAAAGCCCTCCCAGCCCCCATC GAGAAAACCATCTCCAAAACCAAAGGGCAGCCCCG AGAACCACAGGTGTACACCCTGCCCCCATCCCGGG |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | | AGGAGATGACCAAGAACCAGGTCAGCCTGACCTGC CTGGTCGATGGCTTCTACCCCAGCGACATCGCCGTG GAGTGGGAGAGCAATGGGCAGCCGGAGAACAACT ACGATACCACACCTCCCATGCTGGACTCCGACGGCT CCTTCTTCCTCTACAGCGATCTCACCGTGGACAAGA GCAGGTGGCAGCAGGGGAACGTCTTCTCATGCTCC GTGATGCATGAGGCTCTGCACAACCACTACACGCA GAAGAGCCTCTCCCTGTCTCCGGGTAAA (SEQ ID NO: 263) |
| 05A | HC-13 | QVQLQESGPGLVKPSQTL SLTCTVSGGSISSGGYYW SWIRQHPGKGLEWIGYIY YSGNTYYNPSLKSRVTIS GDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLSSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE VHNAKTKPCEEQYGSTY RCVSVLTVLHQDWLNGK EYKCKVSNKALPAPIEKTI SKAKGQPREPQVYTLPPS REEMTKNQVSLTCLVKG FYPSDIAVEWESNGQPEN NYDTTPPVLDSDGSFFLY SDLTVDKSRWQQGNVFS CSVMHEALHNHYTQKSL SLSPGK (SEQ ID NO: 245) | CAGGTGCAGCTGCAGGAGTCGGGCCCAGGACTGGT GAAGCCTTCACAGACCCTGTCCCTCACCTGCACTGT CTCTGGTGGCTCCATCAGCAGTGGTGGTTACTACTG GAGCTGGATCCGCCAGCACCCAGGGAAGGGCCTGG AGTGGATTGGGTACATCTATTACAGTGGGAACACCT ACTACAACCCGTCCCTCAAGAGTCGAGTTACCATAT CAGGAGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGTGAGGAG CAGTACGGCAGCACGTACCGTTGTGTCAGCGTCCTC ACCGTCCTGCACCAGGACTGGCTGAATGGCAAGGA GTACAAGTGCAAGGTCTCCAACAAAGCCCTCCCAG CCCCCATCGAGAAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCAAAGGCTTCTATCCCAGCGACA TCGCCGTGGAGTGGGAGAGCAATGGGCAGCCGGAG AACAACTACGATACCACGCCTCCCGTGCTGGACTCC GACGGCTCCTTCTTCCTCTATAGCGATCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 264) |
| 05B | HC-14 | QVQLQESGPGLVKPSQTL SLTCTVSGGSISSGGYYW SWIRQHPGKKLEWIGYIY YSGNTYYNPSLKSRVTIS GDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLSSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE VHNAKTKPCEEQYGSTY RCVSVLTVLHQDWLNGK EYKCKVSNKALPAPIEKTI SKAKGQPREPQVYTLPPS REEMTKNQVSLTCLVKG FYPSDIAVEWESNGQPEN NYDTTPPVLDSD GSFFLY SDLTVDKSRWQQGNVFS CSVMHEALHNHYTQKSL | CAGGTGCAGCTGCAGGAGTCGGGCCCAGGACTGGT GAAGCCTTCACAGACCCTGTCCCTCACCTGCACTGT CTCTGGTGGCTCCATCAGCAGTGGTGGTTACTACTG GAGCTGGATCCGCCAGCACCCAGGGAAGAAGCTGG AGTGGATTGGGTACATCTATTACAGTGGGAACACCT ACTACAACCCGTCCCTCAAGAGTCGAGTTACCATAT CAGGAGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGTGAGGAG |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | SLSPGK (SEQ ID NO: 246) | CAGTACGGCAGCACGTACCGTTGTGTCAGCGTCCTC ACCGTCCTGCACCAGGACTGGCTGAATGGCAAGGA GTACAAGTGCAAGGTCTCCAACAAAGCCCTCCCAG CCCCCATCGAGAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCAAAGGCTTCTATCCCAGCGACA TCGCCGTGGAGTGGGAGAGCAATGGGCAGCCGGAG AACAACTACGATACCACGCCTCCCGTGCTGGACTCC GACGGCTCCTTCTTCCTCTATAGCGATCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 265) |
| 05C | HC-15 | QVQLQESGPGLVKPSQTL SLTCTVSGGSISSGGYYW SWIRQHPGKGLEWIGYIY YSGNTYYNPSLKSRVTIS GDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLSSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE VHNAKTKPCEEQYGSTY RCVSVLTVLHQDWLNGK EYKCKVSNKALPAPIEKTI SKAKGQPREPQVYTLPPS REEMTKNQVSLTCLVDG FYPSDIAVEWESNGQPEN NYDTTPPVLDSDGSFFLY SDLTVDKSRWQQGNVFS CSVMHEALHNHYTQKSL SLSPGK (SEQ ID NO: 247) | CAGGTGCAGCTGCAGGAGTCGGGCCCAGGACTGGT GAAGCCTTCACAGACCCTGTCCCTCACCTGCACTGT CTCTGGTGGCTCCATCAGCAGTGGTGGTTACTACTG GAGCTGGATCCGCCAGCACCCAGGGAAGGGCCTGG AGTGGATTGGGTACATCTATTACAGTGGGAACACCT ACTACAACCCGTCCCTCAAGAGTCGAGTTACCATAT CAGGAGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGTGAGGAG CAGTACGGCAGCACGTACCGTTGTGTCAGCGTCCTC ACCGTCCTGCACCAGGACTGGCTGAATGGCAAGGA GTACAAGTGCAAGGTCTCCAACAAAGCCCTCCCAG CCCCCATCGAGAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCGATGGCTTCTATCCCAGCGACA TCGCCGTGGAGTGGGAGAGCAATGGGCAGCCGGAG AACAACTACGATACCACGCCTCCCGTGCTGGACTCC GACGGCTCCTTCTTCCTCTATAGCGATCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 266) |
| 05D | HC-16 | QVQLQESGPGLVKPSQTL SLTCTVSGGSISSGGYYW SWIRQHPGKGLEWIGYIY YSGNTYYNPSLKSRVTIS GDTSKNQFSLKLRSVTAA DTAVYYCTRGGAARGM DVWGQGTTVTVSSASTK GPSVFPLAPCSRSTSESTA ALGCLVKDYFPEPVTVS WNSGALTSGVHTFPAVL QSSGLYSLSSVVTVPSSN FGTQTYTCNVDHKPSNT KVDKTVERKCCVECPPCP APPVAGPSVFLFPPKPKD TLMISRTPEVTCVVVDVS HEDPEVQFNWYVDGVEV HNAKTKPREEQFNSTFRV VSVLTVVHQDWLNGKEY KCKVSNKGLPAPIEKTISK TKGQPREPQVYTLPPSRE | CAGGTGCAGCTGCAGGAGTCGGGCCCAGGACTGGT GAAGCCTTCACAGACCCAGTCCCTCACCTGCACTGT CTCTGGTGGCTCCATCAGCAGTGGTGGTTACTACTG GAGCTGGATCCGCCAGCACCCAGGGAAGGGCCTGG AGTGGATTGGGTACATCTATTACAGTGGGAACACCT ACTACAACCCGTCCCTCAAGAGTCGAGTTACCATAT CAGGAGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CGCCCTGCTCCAGGAGCACCTCCGAGAGCACAGCG GCCCTGGGCTGCCTGGTCAAGGACTACTTCCCCGAA CCGGTGACGGTGTCGTGGAACTCAGGCGCTCTGAC CAGCGGCGTGCACACCTTCCCGGCTGTCCTACAGTC CTCAGGACTCTACTCCCTCAAGAGCGTGGTGACCGT GCCCTCCAGCAACTTCGGCACCCAGACCTACACCTG CAACGTAGATCACAAGCCCAGCAACACCAAGGTGG ACAAGACAGTTGAGCGCAAATGTTGTGTCGAGTGC CCACCGTGCCCAGCACCACCTGTGGCAGGACCGTC |

TABLE 6B -continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | EMTKNQVSLTCLVDGFY PSDIAVEWESNGQPENNY DTTPPMLDSDGSFFLYSD LTVDKSRWQQGNVFSCS VMHEALHNHYTQKSLSL SPGK (SEQ ID NO: 248) | AGTCTTCCTCTTCCCCCCAAAACCCAAGGACACCCT CATGATCTCCCGGACCCCTGAGGTCACGTGCGTGGT GGTGGACGTGAGCCACGAAGACCCCGAGGTCCAGT TCAACTGGTACGTGGACGGCGTGGAGGTGCATAAT GCCAAGACAAAGCCACGGGAGGAGCAGTTCAACAG CACGTTCCGTGTGGTCAGCGTCCTCACCGTTGTGCA CCAGGACTGGCTGAACGGCAAGGAGTACAAGTGCA AGGTCTCCAACAAAGGCCTCCCAGCCCCCATCGAG AAAACCATCTCCAAAACCAAAGGGCAGCCCCGAGA ACCACAGGTGTACACCCTGCCCCCATCCCGGGAGG AGATGACCAAGAACCAGGTCAGCCTGACCTGCCTG GTCGATGGCTTCTACCCCAGCGACATCGCCGTGGAG TGGGAGAGCAATGGGCAGCCGGAGAACAACTACGA TACCACACCTCCCATGCTGGACTCCGACGGCTCCTT CTTCCTCTACAGCGATCTCACCGTGGACAAGAGCAG GTGGCAGCAGGGGAACGTCTTCTCATGCTCCGTGAT GCATGAGGCTCTGCACAACCACTACACGCAGAAGA GCCTCTCCCTGTCTCCGGGTAAA (SEQ ID NO: 267) |
| 06A | HC-17 | QVQLQESGPGLVKPSETL SLTCTVSGGSISSGGYYW SWIRQPPGKGLEWIGYIY YSGNTYYNPSLKSRVTIS VDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLKSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE VHNAKTKPCEEQYGSTY RCVSVLTVLHQDWLNGK EYKCKVSNKALPAPIEKTI SKAKGQPREPQVYTLPPS REEMTKNQVSLTCLVKG FYPSDIAVEWESNGQPEN NYDTTPPVLDSDGSFFLY SDLTVDKSRWQQGNVFS CSVMHEALHNHYTQKSL SLSPGK (SEQ ID NO: 249) | CAGGTGCAGCTGCAGGAGTCGGGCCCAGGACTGGT GAAGCCTTCAGAGACCCTGTCCCTCACCTGCACTGT CTCTGGTGGCTCCATCAGCAGTGGTGGTTACTACTG GAGCTGGATCCGCCAGCCCCCAGGGAAGGGCCTGG AGTGGATTGGGTACATCTATTACAGTGGGAACACCT ACTACAACCCGTCCCTCAAGAGTCGAGTTACCATAT CAGTGGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGCGAGGAG CAGTACGGCAGCACGTACCGTTGCGTCAGCGTCCTC ACCGTCCTGCACCAGGACTGGCTGAATGGCAAGGA GTACAAGTGCAAGGTCTCCAACAAAGCCCTCCCAG CCCCCATCGAGAAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCAAAGGCTTCTATCCCAGCGACA TCGCCGTGGAGTGGGAGAGCAATGGGCAGCCGGAG AACAACTACGACACCACGCCTCCCGTGCTGGACTCC GACGGCTCCTTCTTCCTCTATAGCGACCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 268) |
| 06B | HC-18 | QVQLQESGPGLVKPSETL SLTCTVSGGSISSGGYYW SWIRQPPGKKLEWIGYIY YSGNTYYNPSLKSRVTIS VDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLKSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE | CAGGTGCAGCTGCAGGAGTCGGGCCCAGGACTGGT GAAGCCTTCAGAGACCCTGTCCCTCACCTGCACTGT CTCTGGTGGCTCCATCAGCAGTGGTGGTTACTACTG GAGCTGGATCCGCCAGCCCCCAGGGAAGAAGCTGG AGTGGATTGGGTACATCTATTACAGTGGGAACACCT ACTACAACCCGTCCCTCAAGAGTCGAGTTACCATAT CAGTAGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT |

TABLE 6B-continued

Exemplary Anti-PAC1 Receptor Heavy Chain Sequences

| Antibody ID. | HC Group | Heavy Chain Amino Acid Sequence | Heavy Chain Nucleic Acid Sequence |
|---|---|---|---|
| | | VHNAKTKPCEEQYGSTY RCVSVLTVLHQDWLNGK EYKCKVSNKALPAPIEKTI SKAKGQPREPQVYTLPPS REEMTKNQVSLTCLVKG FYPSDIAVEWESNGQPEN NYDTTPPVLDSDGSFFLY SDLTVDKSRWQQGNVFS CSVMHEALHNHYTQKSL SLSPGK (SEQ ID NO: 250) | GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGCGAGGAG CAGTACGGCAGCACGTACCGTTGCGTCAGCGTCCTC ACCGTCCTGCACCAGGACTGGCTGAATGGCAAGGA GTACAAGTGCAAGGTCTCCAACAAAGCCCTCCCAG CCCCCATCGAGAAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCAAAGGCTTCTATCCCAGCGACA TCGCCGTGGAGTGGGAGAGCAATGGGCAGCCGGAG AACAACTACGACACCACGCCTCCCGTGCTGGACTCC GACGGCTCCTTCTTCCTCTATAGCGACCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 269) |
| 06C | HC-19 | QVQLQESGPGLVKPSETL SLTCTVSGGSISSGGYYW SWIRQPPGKGLEWIGYIY YSGNTYYNPSLKSRVTIS VDTSKNQFSLKLRSVTAA DTAVYYCTRGGAARGM DVWGQGTTVTVSSASTK GPSVFPLAPSSKSTSGGTA ALGCLVKDYFPEPVTVS WNSGALTSGVHTFPAVL QSSGLYSLKSVVTVPSSSL GTQTYICNVNHKPSNTKV DKKVEPKSCDKTHTCPPC PAPELLGGPSVFLFPPKPK DTLMISRTPEVTCVVVDV SHEDPEVKFNWYVDGVE VHNAKTKPCEEQYGSTY RCVSVLTVLHQDWLNGK EYKCKVSNKALPAPIEKTI SKAKGQPREPQVYTLPPS REEMTKNQVSLTCLVDG FYPSDIAVEWESNGQPEN NYDTTPPVLDSDGSFFLY SDLTVDKSRWQQGNVFS CSVMHEALHNHYTQKSL SLSPGK (SEQ ID NO: 251) | CAGGTGCAGCTGCAGGAGTCGGGCCCAGGACTGGT GAAGCCTTCAGAGACCCTGTCCCTCACCTGCACTGT CTCTGGTGGCTCCATCAGCAGTGGTGGTTACTACTG GAGCTGGATCCGCCAGCCCCCAGGGAAGGGCCTGG AGTGGATTGGGTACATCTATTACAGTGGGAACACCT ACTACAACCCGTCCCTCAAGAGTCGAGTTACCATAT CAGTGGACACGTCTAAGAACCAGTTCTCCCTGAAG CTGAGGTCTGTGACTGCCGCGGACACGGCCGTGTAT TACTGTACGAGAGGAGGAGCAGCTCGCGGTATGGA CGTCTGGGGCCAAGGGACCACGGTCACCGTCTCTA GTGCCTCCACCAAGGGCCCATCGGTCTTCCCCCTGG CACCCTCCTCCAAGAGCACCTCTGGGGGCACAGCG GCCCTGGGCTGCCTGGTCAAGGACTACTTCCCCGAA CCGGTGACGGTGTCGTGGAACTCAGGCGCCCTGAC CAGCGGCGTGCACACCTTCCCGGCTGTCCTACAGTC CTCAGGACTCTACTCCCTCAAGAGCGTGGTGACCGT GCCCTCCAGCAGCTTGGGCACCCAGACCTACATCTG CAACGTGAATCACAAGCCCAGCAACACCAAGGTGG ACAAGAAAGTTGAGCCCAAATCTTGTGACAAAACT CACACATGCCCACCGTGCCCAGCACCTGAACTCCTG GGGGGACCGTCAGTCTTCCTCTTCCCCCCAAAACCC AAGGACACCCTCATGATCTCCCGGACCCCTGAGGTC ACATGCGTGGTGGTGGACGTGAGCCACGAAGACCC TGAGGTCAAGTTCAACTGGTACGTGGACGGCGTGG AGGTGCATAATGCCAAGACAAAGCCGTGCGAGGAG CAGTACGGCAGCACGTACCGTTGCGTCAGCGTCCTC ACCGTCCTGCACCAGGACTGGCTGAATGGCAAGGA GTACAAGTGCAAGGTCTCCAACAAAGCCCTCCCAG CCCCCATCGAGAAAACCATCTCCAAAGCCAAAGGG CAGCCCCGAGAACCACAGGTGTACACCCTGCCCCC ATCCCGGGAGGAGATGACCAAGAACCAGGTCAGCC TGACCTGCCTGGTCGATGGCTTCTATCCCAGCGACA TCGCCGTGGAGTGGGAGAGCAATGGGCAGCCGGAG AACAACTACGACACCACGCCTCCCGTGCTGGACTCC GACGGCTCCTTCTTCCTCTATAGCGACCTCACCGTG GACAAGAGCAGGTGGCAGCAGGGGAACGTCTTCTC ATGCTCCGTGATGCATGAGGCTCTGCACAACCACTA CACGCAGAAGAGCCTCTCCCTGTCTCCGGGTAAA (SEQ ID NO: 270) |

In some embodiments, the heterodimeric antibody of the invention comprises an anti-PAC1 receptor light chain from Table 6A and an anti-PAC1 receptor heavy chain from Table 6B. Exemplary pairs of anti-PAC1 receptor light and heavy chains that may be incorporated into a heterodimeric antibody include, but are not limited to: LC-01 (SEQ ID NO: 211) and HC-01 (SEQ ID NO: 233); LC-02 (SEQ ID NO: 212) and HC-02 (SEQ ID NO: 234); LC-01 (SEQ ID NO: 211) and HC-03 (SEQ ID NO: 235); LC-01 (SEQ ID NO: 211) and HC-04 (SEQ ID NO: 236); LC-03 (SEQ ID NO: 213) and HC-01 (SEQ ID NO: 233); LC-03 (SEQ ID NO: 213) and HC-03 (SEQ ID NO: 235); LC-04 (SEQ ID NO: 214) and HC-05 (SEQ ID NO: 237); LC-05 (SEQ ID NO: 215) and HC-06 (SEQ ID NO: 238); LC-04 (SEQ ID NO: 214) and HC-07 (SEQ ID NO: 239); LC-04 (SEQ ID NO: 214) and HC-08 (SEQ ID NO: 240); LC-06 (SEQ ID 216) and HC-09 (SEQ ID NO: 241); LC-07 (SEQ ID NO: 217) and HC-10 (SEQ ID NO: 242); LC-06 (SEQ ID NO: 216) and HC-11 (SEQ ID NO: 243); LC-06 (SEQ ID NO: 216) and HC-12 (SEQ ID NO: 244); LC-08 (SEQ ID NO: 218) and HC-13 (SEQ ID NO: 245); LC-09 (SEQ ID NO: 219) and HC-14 (SEQ ID NO: 246); LC-08 (SEQ ID NO: 218) and HC-15 (SEQ ID NO: 247); LC-08 (SEQ ID NO: 218) and HC-16 (SEQ ID NO: 248); LC-10 (SEQ ID NO: 220) and HC-17 (SEQ ID NO: 249); LC-11(SEQ ID NO: 221) and HC-18 (SEQ ID NO: 250); and LC-10 (SEQ ID NO: 220) and HC-19 (SEQ ID NO: 251).

The anti-PAC1 receptor light chain and/or heavy chain incorporated into a heterodimeric antibody of the invention may comprise a sequence of contiguous amino acids that differs from the sequence of a light chain in Table 6A or a heavy chain in Table 6B by 1, 2, 3, 4, 5, 6, 7, 8, 9, 10, 11, 12, 13, 14, 15 or more amino acid residues, wherein each such sequence difference is independently a deletion, insertion or substitution of one amino acid. In some embodiments, the anti-PAC1 receptor light chain incorporated into a heterodimeric antibody comprises a sequence of amino acids that has at least 70%, at least 75%, at least 80%, at least 85%, at least 90%, at least 95%, at least 97% or at least 99% sequence identity to the amino acid sequences of SEQ ID NOs: 211-221 (i.e. the anti-PAC1 receptor light chains in Table 6A). In certain embodiments, the anti-PAC1 receptor heavy chain incorporated into a heterodimeric antibody comprises a sequence of amino acids that has at least 70%, at least 75%, at least 80%, at least 85%, at least 90%, at least 95%, at least 97% or at least 99% sequence identity to the amino acid sequences of SEQ ID NOs: 233-251 (i.e. the anti-PAC1 receptor heavy chains in Table 6B).

Exemplary full-length light chain sequences and full-length heavy chain sequences from anti-CGRP receptor antibodies containing one or more charge pair mutations suitable for use in the heterodimeric antibodies of the invention are shown in Table 7A and Table 7B, respectively.

TABLE 7A

Exemplary Anti-CGRP Receptor Light Chain Sequences

| Antibody ID. | LC Group | Light Chain Amino Acid Sequence | Light Chain Nucleic Acid Sequence |
|---|---|---|---|
| 50A, 50C, 50D | LC-101 | QSVLTQPPSASGTPGQRVTI SCSGSSSNIGSNYVYWYQQ LPGAAPKLLIFRNNQRPSGV PDRFSGSKSGTSASLAISGL RSEDEADYYCAAWDDSLS GWVFGGGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 271) | CAGTCTGTGCTGACTCAGCCACCCTCAGCGTCTGG GACCCCCGGGCAGAGAGTCACCATCTCTTGTTCT GGAAGCAGCTCCAACATCGGCAGTAATTATGTAT ACTGGTACCAGCAGCTCCCAGGAGCGGCCCCCAA ACTCCTCATCTTTAGGAATAATCAGCGGCCCTCAG GGGTCCCTGACCGCTTCTCTGGCTCCAAGTCTGGC ACCTCAGCCTCCCTGGCCATCAGTGGGCTCCGGTC CGAGGATGAGGCTGATTATTACTGTGCAGCATGG GATGACAGCCTGAGTGGTTGGGTGTTCGGCGGAG GGACCAAGCTGACCGTCCTAGGTCAGCCCAAGGC CAACCCCACTGTCACTCTGTTCCCGCCCTCCTCTG AGGAGCTCCAAGCCAACAAGGCCACACTAGTGTG TCTGATCAGTGACTTCTACCCGGGAGCTGTGACA GTGGCCTGGAAGGCAGATGGCAGCCCCGTCAAGG CGGGAGTGGAGACCACCAAACCCTCCAAACAGA GCAACAACAAGTACGCGGCCAAGAGCTACCTGAG CCTGACGCCCGAGCAGTGGAAGTCCCACAGAAGC TACAGCTGCCAGGTCACGCATGAAGGGAGCACCG TGGAGAAGACAGTGGCCCCCTACAGAATGTTCA (SEQ ID NO: 283) |
| 50B | LC-102 | QSVLTQPPSASGTPGQRVTI SCSGSSSNIGSNYVYWYQQ LPGAAPKLLIFRNNQRPSGV PDRFSGSKSGTSASLAISGL RSEDEADYYCAAWDDSLS GWVFGKGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 272) | CAGTCTGTGCTGACTCAGCCACCCTCAGCGTCTGG GACCCCCGGGCAGAGAGTCACCATCTCTTGTTCT GGAAGCAGCTCCAACATCGGCAGTAATTATGTAT ACTGGTACCAGCAGCTCCCAGGAGCGGCCCCCAA ACTCCTCATCGTTAGGAATAATCAGCGGCCCTCAG GGGTCCCTGACCGCTTCTCTGGCTCCAAGTCTGGC ACCTCAGCCTCCCTGGCCATCAGTGGGCTCCGGTC CGAGGATGAGGCTGATTATTACTGTGCAGCATGG GATGACAGCCTGAGTGGTTGGGTGTTCGGCAAGG GGACCAAGCTGACCGTCCTAGGTCAGCCCAAGGC CAACCCCACTGTCACTCTGTTCCCGCCCTCCTCTG AGGAGCTCCAAGCCAACAAGGCCACACTAGTGTG TCTGATCAGTGACTTCTACCCGGGAGCTGTGACA GTGGCCTGGAAGGCAGATGGCAGCCCCGTCAAGG CGGGAGTGGAGACCACCAAACCCTCCAAACAGA GCAACAACAAGTACGCGGCCAAGAGCTACCTGAG CCTGACGCCCGAGCAGTGGAAGTCCCACAGAAGC TACAGCTGCCAGGTCACGCATGAAGGGAGCACCG TGGAGAAGACAGTGGCCCCCTACAGAATGTTCA (SEQ ID NO: 284) |
| 51A, 51C, 51D | LC-103 | QSVLTQSPSASGTPGQRVTI SCSGSSSNIGSNYVYWYQQ LPGAAPKLLILRNNQRPSGV PDRFSGSKSGTSASLTISGL RSEDEADYYCAAWDDSLS GWVFGGGTKLTVLGQPKA NPTVTLFPPSSEELQANKAT LVCLISDFYPGAVTVAWKA DGSPVKAGVETTKPSKQSN | CAGTCTGTGCTGACTCAGTCACCCTCAGCGTCTGG GACCCCCGGGCAGAGAGTCACCATCTCTTGTTCT GGAAGCAGCTCCAACATCGGCAGTAATTATGTAT ACTGGTACCAGCAGCTCCCAGGAGCGGCCCCCAA ACTCCTCATCCTTAGGAATAATCAGCGGCCCTCA GGGTCCCTGACCGATTCTCTGGCTCCAAGTCTGG CACCTCAGCCTCCCTGACCATCAGTGGGCTCCGGT CCGAGGATGAGGCTGACTATTATTGTGCAGCATG GGATGACAGCCTGAGTGGTTGGGTGTTCGGCGGA |

TABLE 7A -continued

Exemplary Anti-CGRP Receptor Light Chain Sequences

| Antibody ID. | LC Group | Light Chain Amino Acid Sequence | Light Chain Nucleic Acid Sequence |
|---|---|---|---|
| | | NKYAAKSYLSLTPEQWKSH RSYSCQVTHEGSTVEKTVA PTECS (SEQ ID NO: 273) | GGGACCAAGCTGACCGTCCTAGGTCAGCCCAAGG CCAACCCCACTGTCACTCTGTTCCCGCCCTCCTCT GAGGAGCTCCAAGCCAACAAGGCCACACTAGTGT GTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 285) |
| 51B | LC-104 | QSVLTQSPSASGTPGQRVTI SCSGSSSNIGSNYVYWYQQ LPGAAPKLLILRNNQRPSGV PDRFSGSKSGTSASLTISGL RSEDEADYYCAAWDDSLS GWVFGKGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 274) | CAGTCTGTGCTGACTCAGTCACCCTCAGCGTCTGG GACCCCCGGGCAGAGAGTCACCATCTCTTGTTCT GGAAGCAGCTCCAACATCGGCAGTAATTATGTAT ACTGGTACCAGCAGCTCCCAGGAGCGGCCCCCAA ACTCCTCATCCTTAGGAATAATCAGCGGCCCTCA GGGGTCCCTGACCGATTCTCTGGCTCCAAGTCTGG CACCTCAGCCTCCCTGACCATCAGTGGGCTCCGGT CCGAGGATGAGGCTGACTATTATTGTGCAGCATG GGATGACAGCCTGAGTGGTTGGGTGTTCGGCAAG GGGACCAAGCTGACCGTCCTAGGTCAGCCCAAGG CCAACCCCACTGTCACTCTGTTCCCGCCCTCCTCT GAGGAGCTCCAAGCCAACAAGGCCACACTAGTGT GTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 286) |
| 52A, 52C, 52D, 53A, 53C | LC-105 | QSVLTQPPSVSAAPGQKVTI SCSGSSSNIGNNYVSWYQQ LPGTAPKLLIYDNNKRPSGI PDRFSGSKSGTSTTLGITGL QTGDEADYYCGTWDSRLS AVVFGGGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 275) | CAGTCTGTGTTGACGCAGCCGCCCTCAGTGTCTGC GGCCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAACCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 287) |
| 52B, 53B | LC-106 | QSVLTQPPSVSAAPGQKVTI SCSGSSSNIGNNYVSWYQQ LPGTAPKLLIYDNNKRPSGI PDRFSGSKSGTSTTLGITGL QTGDEADYYCGTWDSRLS AVVFGKGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 276) | CAGTCTGTGTTGACGCAGCCGCCCTCAGTGTCTGC GGCCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAACCACCCTGGGCATCACCGGACTCCAG ACTGGGGACGAGGCCGATTATTACTGCGGAACAT GGGATAGCCGCCTGAGTGCTGTGGTTTTCGGCAA GGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 288) |

TABLE 7A -continued

Exemplary Anti-CGRP Receptor Light Chain Sequences

| Antibody ID. | LC Group | Light Chain Amino Acid Sequence | Light Chain Nucleic Acid Sequence |
|---|---|---|---|
| 54A, 54C, 56A, 56C | LC-107 | QSVLTQPPSVSAAPGQKVTI SCSGSSSNIGNNYVSWYQQ LPGTAPKLLIYDNNKRPSGI PDRFSGSKSGTSATLGITGL QTGDEADYYCGTWDSRLS AVVFGGGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 277) | CAGTCTGTGTTGACGCAGCCGCCCTCAGTGTCTGC GGGCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 289) |
| 54B, 56B | LC-108 | QSVLTQPPSVSAAPGQKVTI SCSGSSSNIGNNYVSWYQQ LPGTAPKLLIYDNNKRPSGI PDRFSGSKSGTSATLGITGL QTGDEADYYCGTWDSRLS AVVFGKGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 278) | CAGTCTGTGTTGACGCAGCCGCCCTCAGTGTCTGC GGGCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCAA GGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 290) |
| 55A, 55C | LC-109 | QSVLTQPPSVSAAPGQKVTI SCSGSSSNIGNNYVSWYQQ LPGTAPKLLIYDNNKRPSGI PDRFSGSKSGTSATLAITGL QTGDEADYYCGTWDSRLS AVVFGGGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 279) | CAGTCTGTGTTGACGCAGCCGCCCTCAGTGTCTGC GGGCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCGG AGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 291) |
| 55B | LC-110 | QSVLTQPPSVSAAPGQKVTI SCSGSSSNIGNNYVSWYQQ LPGTAPKLLIYDNNKRPSGI PDRFSGSKSGTSATLAITGL QTGDEADYYCGTWDSRLS AVVFGKGTKLTVLGQPKA NPTVTLFPPSSEELQANKAT LVCLISDFYPGAVTVAWKA DGSPVKAGVETTKPSKQSN NKYAAKSYLSLTPEQWKSH RSYSCQVTHEGSTVEKTVA PTECS (SEQ ID NO: 280) | CAGTCTGTGTTGACGCAGCCGCCCTCAGTGTCTGC GGGCCCAGGACAGAAGGTCACCATCTCCTGCTCT GGAAGCAGCTCCAACATTGGGAATAATTATGTAT CCTGGTACCAGCAGCTCCCAGGAACAGCCCCCAA ACTCCTCATTTATGACAATAATAAGCGACCCTCA GGGATTCCTGACCGATTCTCTGGCTCCAAGTCTGG CACGTCAGCCACCCTGGGCATCACCGGACTCCAG ACTGGGGACGAGGCCGATTATTACTGCGGAACAT GGGATAGCCGCCTGAGTGCTGTGGTTTTCGGCAA GGGGACCAAGCTGACCGTCCTAGGTCAGCCCAAG GCCAACCCCACTGTCACTCTGTTCCCGCCCTCCTC TGAGGAGCTCCAAGCCAACAAGGCCACACTAGTG |

TABLE 7A -continued

Exemplary Anti-CGRP Receptor Light Chain Sequences

| Antibody ID. | LC Group | Light Chain Amino Acid Sequence | Light Chain Nucleic Acid Sequence |
|---|---|---|---|
| | | | TGTCTGATCAGTGACTTCTACCCGGGAGCTGTGAC AGTGGCCTGGAAGGCAGATGGCAGCCCCGTCAAG GCGGGAGTGGAGACCACCAAACCCTCCAAACAG AGCAACAACAAGTACGCGGCCAAGAGCTACCTGA GCCTGACGCCCGAGCAGTGGAAGTCCCACAGAAG CTACAGCTGCCAGGTCACGCATGAAGGGAGCACC GTGGAGAAGACAGTGGCCCCTACAGAATGTTCA (SEQ ID NO: 292) |
| 57A, 57C, 57D, 58A, 58C | LC-111 | EIVLTQSPGTLSLSPGERAT LSCRASQSVSSGYLTWYQQ KPGQAPRLLIYGASSRATGI PDRFSGSGSGTDFTLTISRLE PEDFAVYYCQQYGNSLSRF GQGTKLEIKRTVAAPSVFIF PPSDEQLKSGTASVVCLLN NFYPREAKVQWKVDNALQ SGNSQESVTEQDSKDSTYS LKSTLTLSKADYEKHKVYA CEVTHQGLSSPVTKSFNRG EC (SEQ ID NO: 281) | GAAATTGTGTTGACGCAGTCTCCAGGCACCCTGT CTTTGTCTCCAGGGGAAAGAGCCACCCTCTCCTGC AGGGCCAGTCAGAGTGTTAGCAGCGGCTACTTAA CCTGGTACCAGCAGAAACCTGGCCAGGCTCCCAG ACTCCTCATCTATGGTGCATCCAGCAGGGCCACT GGCATCCCAGACAGGTTCAGTGGCAGTGGGTCTG GGACGGACTTCACTCTCACCATCAGCAGACTGGA GCCTGAAGATTTTGCAGTGTATTACTGTCAGCAGT ATGGTAACTCACTGAGCAGGTTTGGCCAGGGGAC CAAGCTGGAAATCAAACGTACGGTGGCTGCACCA TCTGTCTTCATCTTCCCGCCATCTGATGAGCAGTT GAAATCTGGAACTGCCTCTGTTGTGTGCCTGCTGA ATAACTTCTATCCCAGAGAGGCCAAAGTACAGTG GAAGGTGGATAACGCCCTCCAATCGGGTAACTCC CAGGAGAGTGTCACAGAGCAGGACAGCAAGGAC AGCACCTACAGCCTCAAGAGCACCCTGACGCTGA GCAAAGCAGACTACGAGAAACACAAAGTCTACG CCTGCGAAGTCACCCATCAGGGCCTGAGCTCGCC CGTCACAAAGAGCTTCAACAGGGGAGAGTGT (SEQ ID NO: 293) |
| 57B, 58B | LC-112 | EIVLTQSPGTLSLSPGERAT LSCRASQSVSSGYLTWYQQ KPGQAPRLLIYGASSRATGI PDRFSGSGSGTDFTLTISRLE PEDFAVYYCQQYGNSLSRF GKGTKLEIKRTVAAPSVFIF PPSDEQLKSGTASVVCLLN NFYPREAKVQWKVDNALQ SGNSQESVTEQDSKDSTYS LKSTLTLSKADYEKHKVYA CEVTHQGLSSPVTKSFNRG EC (SEQ ID NO: 282) | GAAATTGTGTTGACGCAGTCTCCAGGCACCCTGT CTTTGTCTCCAGGGGAAAGAGCCACCCTCTCCTGC AGGGCCAGTCAGAGTGTTAGCAGCGGCTACTTAA CCTGGTACCAGCAGAAACCTGGCCAGGCTCCCAG ACTCCTCATCTATGGTGCATCCAGCAGGGCCACT GGCATCCCAGACAGGTTCAGTGGCAGTGGGTCTG GTACGGACTTCACTCTCACCATCAGCAGACTGGA GCCTGAAGATTTTGCAGTGTATTACTGTCAGCAGT ATGGTAACTCACTGAGCAGGTTTGGCAAGGGGAC CAAGCTGGAGATCAAACGTACGGTGGCTGCACCA TCTGTCTTCATCTTCCCGCCATCTGATGAGCAGTT GAAATCTGGAACTGCCTCTGTTGTGTGCCTGCTGA ATAACTTCTATCCCAGAGAGGCCAAAGTACAGTG GAAGGTGGATAACGCCCTCCAATCGGGTAACTCC CAGGAGAGTGTCACAGAGCAGGACAGCAAGGAC AGCACCTACAGCCTCAAGAGCACCCTGACGCTGA GCAAAGCAGACTACGAGAAACACAAAGTCTACG CCTGCGAAGTCACCCATCAGGGCCTGAGCTCGCC CGTCACAAAGAGCTTCAACAGGGGAGAGTGT (SEQ ID NO: 294) |

TABLE 7B

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| 50A | HC-101 | EVQLVESGGGLVKPGGSL RLSCAASGFTFGNAWMS WVRQAPGKGLEWVGRIKS KTDGGTTDYAAPVKGRFT ISRDDSKNTLYLQMNSLKT EDTAVYFCTTDRTGYSISW SSYYYYYGMDVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL | GAGGTACAGCTGGTGGAGTCTGGGGGAGGCTTGG TAAAGCCTGGGGGGTCCCTCAGACTCTCCTGTGC AGCCTCTGGATTCACTTTCGGTAACGCCTGGATGA GCTGGGTCCGCCAGGCTCCAGGGAAGGGGCTGGA GTGGGTTGGCCGTATTAAAAGCAAAACTGATGGT GGGACAACAGACTACGCTGCACCCGTGAAAGGCA GATTCACCATCTCAAGAGATGATTCAAAAAACAC GCTGTATCTGCAAATGAACAGCCTGAAAACCGAG GACACAGCCGTGTATTTCTGTACCACAGATCGGA CCGGGTATAGCATCAGCTGGTCTAGTTACTACTAC TACTACGGTATGGACGTCTGGGGCCAAGGAACAA CAGTTACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 295) | CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCCC TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCATCCCGGAAGGAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 317) |
| 50B | HC-102 | EVQLVESGGGLVKPGGSL RLSCAASGFTFGNAWMS WVRQAPGKELEWVGRIKS KTDGGTTDYAAPVKGRFT ISRDDSKNTLYLQMNSLKT EDTAVYFCTTDRTGYSISW SSYYYYGMDVWGQTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 296) | GAGGTACAGCTGGTGGAGTCTGGGGGAGGCTTGG TAAAGCCTGGGGGGTCCCTCAGACTCTCCTGTGC AGCCTCTGGATTCACTTTCGGTAACGCCTGGATGA GCTGGGTCCGCCAGGCTCCAGGGAAGGAGCTGGA GTGGGTTGGCCGTATTAAAAGCAAAACTGATGGT GGGACAACAGACTACGCTGCACCCGTGAAAGGCA GATTCACCATCTCAAGAGATGATTCAAAAAACAC GCTGTATCTGCAAATGAACAGCCTGAAAACCGAG GACACAGCCGTGTATTTCTGTACCACAGATCGGA CCGGGTATAGCATCAGCTGGTCTAGTTACTACTAC TACTACGGTATGGACGTCTGGGGCCAAGGAACAA CAGTTACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCCC TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCATCCCGGAAGGAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 318) |
| 50C | HC-103 | EVQLVESGGGLVKPGGSL RLSCAASGFTFGNAWMS WVRQAPGKGLEWVGR1KS | GAGGTACAGCTGGTGGAGTCTGGGGGAGGCTTGG TAAAGCCTGGGGGGTCCCTCAGACTCTCCTGTGC AGCCTCTGGATTCACTTTCGGTAACGCCTGGATGA |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | KTDGGTTDYAAPVKGRFT ISRDDSKNTLYLQMNSLKT EDTAVYFCTTDRTGYSISW SSYYYYYGMDVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKKMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 297) | GCTGGGTCCGCCAGGCTCCAGGGAAGGGGCTGGA GTGGGTTGGCCGTATTAAAAGCAAAACTGATGGT GGGACAACAGACTACGCTGCACCCGTGAAAGGCA GATTCACCATCTCAAGAGATGATTCAAAAAACAC GCTGTATCTGCAAATGAACAGCCTGAAAACCGAG GACACAGCCGTGTATTTCTGTACCACAGATCGGA CCGGGTATAGCATCAGCTGGTCTAGTTACTACTAC TACTACGGTATGGACGTCTGGGGCCAAGGAACAA CAGTTACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCCATCCCGGAAGAAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 319) |
| 50D | HC-104 | EVQLVESGGGLVKPGGSL RLSCAASGFTFGNAWMS WVRQAPGKGLEWVGRIKS KTDGGTTDYAAPVKGRFT ISRDDSKNTLYLQMNSLKT EDTAVYFCTTDRTGYSISW SSYYYYYGMDVWGQGTT VTVSSASTKGPSVFPLAPC SRSTSESTAALGCLVKDYF PEPVTVSWNSGALTSGVH TFPAVLQSSGLYSLESVVT VPSSNFGTQTYTCNVDHK PSNTKVDKTVERKCCVEC PPCPAPPVAGPSVFLPPKP KDTLMISRTPEVTCVVVD VSHEDPEVQFNWYVDGVE VHNAKTKPREEQFNSTFR VVSVLTVVHQDWLNGKE YKCKVSNKGLPAPIEKTIS KTKGQPREPQVYTLPPSRK KMTKNQVSLTCLVKGFYP SDIAVEWESNGQPENNYK TTPPMLKSDGSFFLYSKLT VDKSRWQQGNVFSCSVM HEALHNHYTQKSLSLSPG K (SEQ ID NO: 298) | GAGGTACAGCTGGTGGAGTCTGGGGGAGGCTTGG TAAAGCCTGGGGGGTCCCTCAGACTCTCCTGTGC AGCCTCTGGATTCACTTTCGGTAACGCCTGGATGA GCTGGGTCCGCCAGGCTCCAGGGAAGGGGCTGGA GTGGGTTGGCCGTATTAAAAGCAAAACTGATGGT GGGACAACAGACTACGCTGCACCCGTGAAAGGCA GATTCACCATCTCAAGAGATGATTCAAAAAACAC GCTGTATCTGCAAATGAACAGCCTGAAAACCGAG GACACAGCCGTGTATTTCTGTACCACAGATCGGA CCGGGTATAGCATCAGCTGGTCTAGTTACTACTAC TACTACGGTATGGACGTCTGGGGCCAAGGAACAA CAGTTACCGTCTCTAGTGCCTCCACCAAGGGCCC ATCGGTCTTCCCCCTGGCGCCCTGCTCCAGGAGCA CCTCCGAGAGCACAGCGGCCCTGGGCTGCCTGGT CAAGGACTACTTCCCCGAACCGGTGACGGTGTCG TGGAACTCAGGCGCTCTGACCAGCGGCGTGCACA CCTTCCCAGCTGTCCTACAGTCCTCAGGACTCTAC TCCCTGGAGAGCGTGGTGACCGTGCCCTCCAGCA ACTTCGGCACCCAGACCTACACCTGCAACGTAGA TCACAAGCCCAGCAACACCAAGGTGGACAAGAC AGTTGAGCGCAAATGTTGTGTCGAGTGCCCACCG TGCCCAGCACCACCTGTGGCAGGACCGTCAGTCT TCCTCTTCCCCCCAAAACCCAAGGACACCCTCATG ATCTCCCGGACCCCTGAGGTCACGTGCGTGGTGG TGGACGTGAGCCACGAAGACCCCGAGGTCCAGTT CAACTGGTACGTGGACGGCGTGGAGGTGCATAAT GCCAAGACAAAGCCACGGGAGGAGCAGTTCAAC AGCACGTTCCGTGTGGTCAGCGTCCTCACCGTTGT GCACCAGGACTGGCTGAACGGCAAGGAGTACAA GTGCAAGGTCTCCAACAAAGCCTCCCAGCCCCC ATCGAGAAAACCATCTCCAAAACCAAAGGGCAGC CCCGAGAACCACAGGTGTACACCCTGCCCCCATC CCGGAAGAAGATGACCAAGAACCAGGTCAGCCT GACCTGCCTGGTCAAAGGCTTCTACCCCAGCGAC ATCGCCGTGGAGTGGGAGAGCAATGGGCAGCCG |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | | GAGAACAACTACAAGACCACACCTCCCATGCTGA AGTCCGACGGCTCCTTCTTCCTCTACAGCAAGCTC ACCGTGGACAAGAGCAGGTGGCAGCAGGGGAAC GTCTTCTCATGCTCCGTGATGCATGAGGCTCTGCA CAACCACTACACGCAGAAGAGCCTCTCCCTGTCT CCGGGTAAA (SEQ ID NO: 320) |
| 51A | HC-105 | EVQLVESGGGLVKPGGSL RLSCAASGFTFSNAWMSW VRQAPGKGLEWVGRIKSK TDGGTTDYTAPVKGRFTIS RDDSKNTLYLQMNSLKAE DTAVYYCTTDRTGYSISW SSYYYYGMDVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 299) | GAGGTGCAGCTGGTGGAGTCTGGGGGAGGCTTGG TAAAGCCTGGGGGGTCCCTTAGACTCTCCTGTGC AGCCTCTGGATTCACTTTCAGTAACGCCTGGATGA GCTGGGTCCGCCAGGCTCCAGGGAAGGGGCTGGA GTGGGTTGGCCGTATTAAAAGCAAAACTGATGGT GGGACAACAGACTACACTGCACCCGTGAAAGGCA GATTCACCATCTCAAGAGATGATTCAAAAAACAC GCTGTATCTGCAAATGAATAGCCTGAAAGCCGAG GACACAGCCGTGTATTACTGTACCACAGATCGGA CCGGGTATAGCATCAGCTGGTCTAGTTACTACTAC TACTACGGTATGGACGTCTGGGGCCAAGGGACAA CAGTTACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCCATCCCGGGAAGGAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 321) |
| 51B | HC-106 | EVQLVESGGGLVKPGGSL RLSCAASGFTFSNAWMSW VRQAPGKELEWVGRIKSK TDGGTTDYTAPVKGRFTIS RDDSKNTLYLQMNSLKAE DTAVYYCTTDRTGYSISW SSYYYYGMDVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL | GAGGTGCAGCTGGTGGAGTCTGGGGGAGGCTTGG TAAAGCCTGGGGGGTCCCTTAGACTCTCCTGTGC AGCCTCTGGATTCACTTTCAGTAACGCCTGGATGA GCTGGGTCCGCCAGGCTCCAGGGAAGGAGCTGGA GTGGGTTGGCCGTATTAAAGCAAAACTGATGGT GGGACAACAGACTACACTGCACCCGTGAAAGGCA GATTCACCATCTCAAGAGATGATTCAAAAAACAC GCTGTATCTGCAAATGAATAGCCTGAAAGCCGAG GACACAGCCGTGTATTACTGTACCACAGATCGGA CCGGGTATAGCATCAGCTGGTCTAGTTACTACTAC TACTACGGTATGGACGTCTGGGGCCAAGGGACAA CAGTTACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | SPGK (SEQ ID NO: 300) | TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCCATCCCGGAAGGAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 322) |
| 51C | HC-107 | EVQLVESGGGLVKPGGSL RLSCAASGFTFSNAWMSW VRQAPGKGLEWVGRIKSK TDGGTTDYTAPVKGRFTIS RDDSKNTLYLQMNSLKAE DTAVYYCTTDRTGYSISW SSYYYYGMDVWGQGTT VTVSSASTKGPSVFPLAPS SKSTSGGTAALGCLVKDY FPEPVTVSWNSGALTSGV VHTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKKMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 301) | GAGGTGCAGCTGGTGGAGTCTGGGGGAGGCTTGG TAAAGCCTGGGGGGTCCCTTAGACTCTCCTGTGC AGCCTCTGGATTCACTTTCAGTAACGCCTGGATGA GCTGGGTCCGCCAGGCTCCAGGGAAGGGGCTGGA GTGGGTTGGCCGTATTAAAAGCAAAACTGATGGT GGGACAACAGACTACACTGCACCCGTGAAAGGCA GATTCACCATCTCAAGAGATGATTCAAAAAACAC GCTGTATCTGCAAATGAATAGCCTGAAAGCCGAG GACACAGCCGTGTATTACTGTACCACAGATCGGA CCGGGTATAGCATCAGCTGGTCTAGTTACTACTAC TACTACGGTATGGACGTCTGGGGCCAAGGGACAA CAGTTACCGTCTCTAGTGCCTCCACCAAGGGCCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCGAGAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGCGAG GAGCAGTACGGCAGCACGTACCGTTGCGTCAGCG TCCTCACCGTCCTGCACCAGGACTGGCTGAATGG CAAGGAGTACAAGTGCAAGGTCTCCAACAAAGCC CTCCCAGCCCCCATCGAGAAAACCATCTCCAAAG CCAAAGGGCAGCCCCGAGAACCACAGGTGTACAC CCTGCCCCCATCCCGGAAGAAGATGACCAAGAAC CAGGTCAGCCTGACCTGCCTGGTCAAAGGCTTCT ATCCCAGCGACATCGCCGTGGAGTGGGAGAGCAA TGGGCAGCCGGAGAACAACTACAAGACCACGCCT CCCGTGCTGAAGTCCGACGGCTCCTTCTTCCTCTA TAGCAAGCTCACCGTGGACAAGAGCAGGTGGCAG CAGGGGAACGTCTTCTCATGCTCCGTGATGCATG AGGCTCTGCACAACCACTACACGCAGAAGAGCCT CTCCCTGTCTCCGGGTAAA (SEQ ID NO: 323) |
| 51D | HC-108 | EVQLVESGGGLVKPGGSL RLSCAASGFTFSNAWMSW VRQAPGKGLEWVGRIKSK TDGGTTDYTAPVKGRFTIS RDDSKNTLYLQMNSLKAE DTAVYYCTTDRTGYSISW SSYYYYGMDVWGQGTT VTVSSASTKGPSVFPLAPC SRSTSESTAALGCLVKDYF PEPVTVSWNSGALTSGVH TFPAVLQSSGLYSLESVVT VPSSNFGTQTYTCNVDHK PSNTKVDKTVERKCCVEC PPCPAPPVAGPSVFLFPPKP | GAGGTGCAGCTGGTGGAGTCTGGGGGAGGCTTGG TAAAGCCTGGGGGGTCCCTTAGACTCTCCTGTGC AGCCTCTGGATTCACTTTCAGTAACGCCTGGATGA GCTGGGTCCGCCAGGCTCCAGGGAAGGGGCTGGA GTGGGTTGGCCGTATTAAAAGCAAAACTGATGGT GGGACAACAGACTACACTGCACCCGTGAAAGGCA GATTCACCATCTCAAGAGATGATTCAAAAAACAC GCTGTATCTGCAAATGAATAGCCTGAAAGCCGAG GACACAGCCGTGTATTACTGTACCACAGATCGGA CCGGGTATAGCATCAGCTGGTCTAGTTACTACTAC TACTACGGTATGGACGTCTGGGGCCAAGGAACAA CAGTTACCGTCTCTAGTGCCTCCACCAAGGGCCCC ATCGGTCTTCCCCCTGGCGCCCTGCTCCAGGAGCA CCTCCGAGAGCACAGCGGCCCTGGGCTGCCTGGT |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | KDTLMISRTPEVTCVVVD VSHEDPEVQFNWYVDGVE VHNAKTKPREEQFNSTFR VVSVLTVVHQDWLNGKE YKCKVSNKGLPAPIEKTIS KTKGQPREPQVYTLPPSRK KMTKNQVSLTCLVKGFYP SDIAVEWESNGQPENNYK TTPPMLKSDGSFFLYSKLT VDKSRWQQGNVFSCSVM HEALHNHYTQKSLSLSPG K (SEQ ID NO: 302) | CAAGGACTACTTCCCCGAACCGGTGACGGTGTCG TGGAACTCAGGCGCTCTGACCAGCGGCGTGCACA CCTTCCCAGCTGTCCTACAGTCCTCAGGACTCTAC TCCCTGGAGAGCGTGGTGACCGTGCCCTCCAGCA ACTTCGGCACCCAGACCTACACCTGCAACGTAGA TCACAAGCCCAGCAACACCAAGGTGGACAAGAC AGTTGAGCGCAAATGTTGTGTCGAGTGCCCACCG TGCCCAGCACCACCTGTGGCAGGACCGTCAGTCT TCCTCTTCCCCCCAAAACCCAAGGACACCCTCATG ATCTCCCGGACCCCTGAGGTCACGTGCGTGGTGG TGGACGTGAGCCACGAAGACCCCGAGGTCCAGTT CAACTGGTACGTGGACGGCGTGGAGGTGCATAAT GCCAAGACAAAGCCACGGGAGGAGCAGTTCAAC AGCACGTTCCGTGTGGTCAGCGTCCTCACCGTTGT GCACCAGGACTGGCTGAACGGCAAGGAGTACAA GTGCAAGGTCTCCAACAAAGGCCTCCCAGCCCCC ATCGAGAAAACCATCTCCAAAACCAAAGGGCAGC CCCGAGAACCACAGGTGTACACCCTGCCCCCATC CCGGAAGAAGATGACCAAGAACCAGGTCAGCCT GACCTGCCTGGTCAAAGGCTTCTACCCCAGCGAC ATCGCCGTGGAGTGGGAGAGCAATGGGCAGCCG GAGAACAACTACAAGACCACACCTCCCATGCTGA AGTCCGACGGCTCCTTCTTCCTCTACAGCAAGCTC ACCGTGGACAAGAGCAGGTGGCAGCAGGGGAAC GTCTTCTCATGCTCCGTGATGCATGAGGCTCTGCA CAACCACTACACGCAGAAGAGCCTCTCCCTGTCT CCGGGTAAA (SEQ ID NO: 324) |
| 52A, 54A, 55A | HC-109 | QVQLVESGGGVVQPGRSL RLSCAASGFTFSSFGMHW VRQAPGKGLEWVAVISFD GSIKYSVDSVKGRFTISRD NSKNTLFLQMNSLRAEDT AVYYCARDRLNYYDSSGY YHYKYYGMAVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 303) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TAAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGAAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGAAGTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 325) |
| 52B, 54B, 55B | HC-110 | QVQLVESGGGVVQPGRSL RLSCAASGFTFSSFGMHW VRQAPGKELEWVAVISFD GSIKYSVDSVKGRFTISRD NSKNTLFLQMNSLRAEDT | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGGAAGGAGCTGGA GTGGGTGGCAGTTATATCATTTGATGGAAGTATT |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | AVYYCARDRLNYYDSSGY YHYKYYGMAVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 304) | AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGAAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGAAGTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTCTCCC TGTCTCCGGGTAAA (SEQ ID NO: 326) |
| 52C, 54C, 55C | HC-111 | QVQLVESGGGVVQPGRSL RLSCAASGFTFSSFGMHW VRQAPGKGLEWVAVISFD GSIKYSVDSVKGRFTISRD NSKNTLFLQMNSLRAEDT AVYYCARDRLNYYDSSGY YHYKYYGMAVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKKMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 305) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGAACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAGAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGCGAGGAGCA GTACGGCAGCACGTACCGTTGCGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGAAGAAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGAAGTCCGACGGCTCCTTCTTCCTCTATAGCA AGCTCACCGTGGACAAGAGCAGGTGGCAGCAGG |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | | GGAACGTCTTCTCATGCTCCGTGATGCATGAGGCT CTGCACAACCACTACACGCAGAAGAGCCTCTCCC TGTCTCCGGGTAAA (SEQ ID NO: 327) |
| 52D | HC-112 | QVQLVESGGGVVQPGRSL RLSCAASGFTFSSFGMHW VRQAPGKGLEWVAVISFD GSIKYSVDSVKGRFTISRD NSKNTLFLQMNSLRAEDT AVYYCARDRLNYYDSSGY YHYKYYGMAVWGQGTT VTVSSASTKGPSVFPLAPC SRSTSESTAALGCLVKDYF PEPVTVSWNSGALTSGVH TFPAVLQSSGLYSLESVVT VPSSNFGTQTYTCNVDHK PSNTKVDKTVERKCCVEC PPCPAPPVAGPSVFLFPPKP KDTLMISRTPEVTCVVVD VSHEDPEVQFNWYVDGVE VHNAKTKPREEQFNSTFR VVSVLTVVHQDWLNGKE YKCKVSNKGLPAPIEKTIS KTKGQPREPQVYTLPPSRK KMTKNQVSLTCLVKGFYP SDIAVEWESNGQPENNYK TTPPMLKSDGSFFLYSKL VDKSRWQQGNVFSCSVM HEALHNHYTQKSLSLSPG K (SEQ ID NO: 306) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCGCCCTGCTCCAGGAGCACCTC CGAGAGCACAGCGGCCCTGGGCTGCCTGGTCAAG GACTACTTCCCCGAACCGGTGACGGTGTCGTGGA ACTCAGGCGCTCTGACCAGCGGCGTGCACACCTT CCCAGCTGTCCTACAGTCCTCAGGACTCTACTCCC TGGAGAGCGTGGTGACCGTGCCCTCCAGCAACTT CGGCACCCAGACCTACACCTGCAACGTAGATCAC AAGCCCAGCAACACCAAGGTGGACAAGACAGTT GAGCGCAAATGTTGTGTCGAGTGCCCACCGTGCC CAGCACCACCTGTGGCAGGACCGTCAGTCTTCCT TCTTCCCCCCAAAACCCAAGGACACCCTCATGATC TCCCGGACCCCTGAGGTCACGTGCGTGGTGGTGG ACGTGAGCCACGAAGACCCCGAGGTCCAGTTCAA CTGGTACGTGGACGGCGTGGAGGTGCATAATGCC AAGACAAAGCCACGGGAGGAGCAGTTCAACAGC ACGTTCCGTGTGGTCAGCGTCCTCACCGTTGTGCA CCAGGACTGGCTGAACGGCAAGGAGTACAAGTGC AAGGTCTCCAACAAAGGCCTCCCAGCCCCCATCG AGAAAACCATCTCCAAAACCAAAGGGCAGCCCCG AGAACCACAGGTGTACACCCTGCCCCCATCCCGG AAGGAGATGACCAAGAACCAGGTCAGCCTGACCT GCCTGGTCAAAGGCTTCTACCCCAGCGACATCGC CGTGGAGTGGGAGAGCAATGGGCAGCCGGAGAA CAACTACAAGACCACACCTCCCATGCTGAAGTCC GACGGCTCCTTCTTCCTCTACAGCAAGCTCACCGT GGACAAGAGCAGGTGGCAGCAGGGGAACGTCTT CTCATGCTCCGTGATGCATGAGGCTCTGCACAAC CACTACACGCAGAAGAGCCTCTCCCTGTCTCCGG GTAAA (SEQ ID NO: 328) |
| 53A, 56A | HC-113 | QVQLVESGGGVVQPGRSL RLSCAASGFTFSSFGMHW VRQAPGKGLEWVAVISFD GSIKYSVDSVKGRFTISRD NSKNTLFLQMNSLRAEDT AVYYCARDRLNYYESSGY YHYKYYGMAVWGQGTT VTVSSASTKGPSVFPLAPS SKSTSGGTAALGCLVKDY FPEPVTVSWNSGALTSGV HTFPAVLQSSGLYSLESVV TVPSSSLGTQTYICNVNHK PSNTKVDKKVEPKSCDKT HTCPPCPAPELLGGPSVFL FPPKPKDTLMISRTPEVTC VVVDVSHEDPEVKFNWY VDGVEVHNAKTKPCEEQY GSTYRCVSVLTVLHQDWL NGKEYKCKVSNKALPAPI EKTISKAKGQPREPQVYTL PPSRKEMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 307) | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAGAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCAGCAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTAAAGTTCAACTGGTACGTGGACGGCGTGGAG GTGCATAATGCCAAGACAAAGCCGTGCGAGGAGC AGTACGGCAGCACGTACCGTTGCGTCAGCGTCCT CACCGTCCTGCACCAGGACTGGCTGAATGGCAAG |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | | GAGTACAAGTGCAAGGTCTCCAACAAAGCCCTCC<br>CAGCCCCCATCGAGAAAACCATCTCCAAAGCCAA<br>AGGGCAGCCCCGAGAACCACAGGTGTACACCCTG<br>CCCCCATCCCGGAAGGAGATGACCAAGAACCAGG<br>TCAGCCTGACCTGCCTGGTCAAAGGCTTCTATCCC<br>AGCGACATCGCCGTGGAGTGGGAGAGCAATGGG<br>CAGCCGGAGAACAACTACAAGACCACGCCTCCCG<br>TGCTGAAGTCCGACGGCTCCTTCTTCCTCTATAGC<br>AAGCTCACCGTGGACAAGAGCAGGTGGCAGCAG<br>GGGAACGTCTTCTCATGCTCCGTGATGCATGAGG<br>CTCTGCACAACCACTACACGCAGAAGAGCCTCTC<br>CCTGTCTCCGGGTAAA (SEQ ID NO: 329) |
| 53B, 56B | HC-114 | QVQLVESGGGVVQPGRSL<br>RLSCAASGFTFSSFGMHW<br>VRQAPGKELEWVAVISFD<br>GSIKYSVDSVKGRFTISRD<br>NSKNTLFLQMNSLRAEDT<br>AVYYCARDRLNYYESSGY<br>YHYKYYGMAVWGQGTT<br>VTVSSASTKGPSVFPLAPS<br>SKSTSGGTAALGCLVKDY<br>FPEPVTVSWNSGALTSGV<br>HTFPAVLQSSGLYSLESVV<br>TVPSSSLGTQTYICNVNHK<br>PSNTKVDKKVEPKSCDKT<br>HTCPPCPAPELLGGPSVFL<br>FPPKPKDTLMISRTPEVTC<br>VVVDVSHEDPEVKFNWY<br>VDGVEVHNAKTKPCEEQY<br>GSTYRCVSVLTVLHQDWL<br>NGKEYKCKVSNKALPAPI<br>EKTISKAKGQPREPQVYTL<br>PPSRKEMTKNQVSLTCLV<br>KGFYPSDIAVEWESNGQPE<br>NNYKTTPPVLKSDGSFFLY<br>SKLTVDKSRWQQGNVFSC<br>SVMHEALHNHYTQKSLSL<br>SPGK (SEQ ID NO: 308) | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGGAAGGAGCTGGA<br>GTGGGTGGCAGTTATATCATTTGATGGAAGTATT<br>AAGTATTCTGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTCTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCGAGAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT<br>TGAGCCCAAATCTTGTGACAAAACTCACACATGC<br>CCACCGTGCCCAGCACCTGAACTCCTGGGGGGAC<br>CGTCAGTCTTCCTCTTCCCCCCAAAACCCAAGGAC<br>ACCCTCATGATCTCCCGGACCCCTGAGGTCACAT<br>GCGTGGTGGTGGACGTGAGCCACGAAGACCCTGA<br>GGTCAAGTTCAACTGGTACGTGGACGGCGTGGAG<br>GTGCATAATGCCAAGACAAAGCCGTGCGAGGAGC<br>AGTACGGCAGCACGTACCGTTGCGTCAGCGTCCT<br>CACCGTCCTGCACCAGGACTGGCTGAATGGCAAG<br>GAGTACAAGTGCAAGGTCTCCAACAAAGCCCTCC<br>CAGCCCCCATCGAGAAAACCATCTCCAAAGCCAA<br>AGGGCAGCCCCGAGAACCACAGGTGTACACCCTG<br>CCCCCATCCCGGAAGGAGATGACCAAGAACCAGG<br>TCAGCCTGACCTGCCTGGTCAAAGGCTTCTATCCC<br>AGCGACATCGCCGTGGAGTGGGAGAGCAATGGG<br>CAGCCGGAGAACAACTACAAGACCACGCCTCCCG<br>TGCTGAAGTCCGACGGCTCCTTCTTCCTCTATAGC<br>AAGCTCACCGTGGACAAGAGCAGGTGGCAGCAG<br>GGGAACGTCTTCTCATGCTCCGTGATGCATGAGG<br>CTCTGCACAACCACTACACGCAGAAGAGCCTCTC<br>CCTGTCTCCGGGTAAA (SEQ ID NO: 330) |
| 53C, 56C | HC-115 | QVQLVESGGGVVQPGRSL<br>RLSCAASGFTFSSFGMHW<br>VRQAPGKGLEWVAVISFD<br>GSIKYSVDSVKGRFTISRD<br>NSKNTLFLQMNSLRAEDT<br>AVYYCARDRLNYYESSGY<br>YHYKYYGMAVWGQGTT<br>VTVSSASTKGPSVFPLAPS<br>SKSTSGGTAALGCLVKDY<br>FPEPVTVSWNSGALTSGV<br>HTFPAVLQSSGLYSLESVV<br>TVPSSSLGTQTYICNVNHK<br>PSNTKVDKKVEPKSCDKT<br>HTCPPCPAPELLGGPSVFL<br>FPPKPKDTLMISRTPEVTC<br>VVVDVSHEDPEVKFNWY<br>VDGVEVHNAKTKPCEEQY<br>GSTYRCVSVLTVLHQDWL<br>NGKEYKCKVSNKALPAPI<br>EKTISKAKGQPREPQVYTL | CAGGTGCAGCTGGTGGAATCTGGGGGAGGCGTGG<br>TCCAGCCTGGGAGGTCCCTGAGACTCTCCTGTGC<br>AGCCTCTGGATTCACCTTCAGTAGCTTTGGCATGC<br>ACTGGGTCCGCCAGGCTCCAGGCAAGGGGCTGGA<br>GTGGGTGGCAGTTATATCATTTGATGGAAGTATT<br>AAGTATTCTGTAGACTCCGTGAAGGGCCGATTCA<br>CCATCTCCAGAGACAATTCAAAGAACACGCTGTT<br>TCTGCAAATGAACAGCCTGCGAGCCGAGGACACG<br>GCTGTGTATTACTGTGCGAGAGATCGGCTCAATT<br>ACTATGAGAGTAGTGGTTATTATCACTACAAATA<br>CTACGGTATGGCCGTCTGGGGCCAAGGGACAACA<br>GTTACCGTCTCTAGTGCCTCCACCAAGGGCCCATC<br>GGTCTTCCCCCTGGCACCCTCCTCCAAGAGCACCT<br>CTGGGGGCACAGCGGCCCTGGGCTGCCTGGTCAA<br>GGACTACTTCCCCGAACCGGTGACGGTGTCGTGG<br>AACTCAGGCGCCCTGACCAGCGGCGTGCACACCT<br>TCCCGGCTGTCCTACAGTCCTCAGGACTCTACTCC<br>CTCGAGAGCGTGGTGACCGTGCCCTCCAGCAGCT<br>TGGGCACCCAGACCTACATCTGCAACGTGAATCA<br>CAAGCCCAGCAACACCAAGGTGGACAAGAAAGT |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | PPSRKKMTKNQVSLTCLV KGFYPSDIAVEWESNGQPE NNYKTTPPVLKSDGSFFLY SKLTVDKSRWQQGNVFSC SVMHEALHNHYTQKSLSL SPGK (SEQ ID NO: 309) | TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGCGAGGAGC AGTACGGCAGCACGTACCGTTGCGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGAAGAAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGAAGTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTCTC CCTGTCTCCGGGTAAA (SEQ ID NO: 331) |
| 57A | HC-116 | QVQLVESGGGVVQPGRSL RLSCAASGFTFSSYGMHW VRQAPGKGLEWVAVIWY DGSNKYYADSVKGRFIISR DKSKNTLYLQMNSLRAED TAVYYCARAGGIAAAGLY YYYGMDVWGQGTTVTVS SASTKGPSVFPLAPSSKSTS GGTAALGCLVKDYFPEPV TVSWNSGALTSGVHTFPA VLQSSGLYSLESVVTVPSS SLGTQTYICNVNHKPSNTK VDKKVEPKSCDKTHTCPP CPAPELLGGPSVFLFPPKP KDTLMISRTPEVTCVVVD VSHEDPEVKFNWYVDGVE VHNAKTKPCEEQYGSTYR CVSVLTVLHQDWLNGKE YKCKVSNKALPAPIEKTIS KAKGQPREPQVYTLPPSR KEMTKNQVSLTCLVKGFY PSDIAVEWESNGQPENNY KTTPPVLKSDGSFFLYSKL TVDKSRWQQGNVFSCSV MHEALHNHYTQKSLSLSP GK (SEQ ID NO: 310) | CAGGTGCAGCTGGTGGAGTCTGGGGGAGGCGTGG TCCAGCCTGGGAGGTCCCTGAGACTCTCCTGTGC AGCGTCTGGATTCACCTTCAGTAGCTATGGCATGC ACTGGGTCCGCCAGGCTCCAGGCAAGGGGCTGGA GTGGGTGGCAGTTATATGGTATGATGGAAGTAAT AAATACTATGCAGACTCCGTGAAGGGCCGATTCA TCATCTCCAGAGATAAATCCAAGAACACGCTGTA TCTGCAAATGAACAGCCTGAGAGCCGAGGACACG GCTGTGTATTACTGTGCGAGAGCGGGGGGTATAG CAGCAGCTGGCCTCTACTACTACTACGGTATGGA CGTCTGGGGCCAAGGGACAACAGTTACCGTCTCT AGTGCCTCCACCAAGGGCCCATCGGTCTTCCCCCT GGCACCCTCCTCCAAGAGCACCTCTGGGGGCACA GCGGCCCTGGGCTGCCTGGTCAAGGACTACTTCC CCGAACCGGTGACGGTGTCGTGGAACTCAGGCGC CCTGACCAGCGGCGTGCACACCTTCCCGGCTGTC CTACAGTCCTCAGGACTCTACTCCCTCAGAGCGT GGTGACCGTGCCCTCCAGCAGCTTGGGCACCCAG ACCTACATCTGCAACGTGAATCACAAGCCCAGCA ACACCAAGGTGGACAAGAAAGTTGAGCCCAAATC TTGTGACAAAACTCACACATGCCCACCGTGCCCA GCACCTGAACTCCTGGGGGGACCGTCAGTCTTCC TCTTCCCCCCAAAACCCAAGGACACCCTCATGAT CTCCCGGACCCCTGAGGTCACATGCGTGGTGGTG GACGTGAGCCACGAAGACCCTGAGGTCAAGTTCA ACTGGTACGTGGACGGCGTGGAGGTGCATAATGC CAAGACAAAGCCGTGCGAGGAGCAGTACGGCAG CACGTACCGTTGCGTCAGCGTCCTCACCGTCCTGC ACCAGGACTGGCTGAATGGCAAGGAGTACAAGTG CAAGGTCTCCAACAAAGCCCTCCCAGCCCCCATC GAGAAAACCATCTCCAAAGCCAAAGGGCAGCCCC GAGAACCACAGGTGTACACCCTGCCCCCATCCCG GAAGGAGATGACCAAGAACCAGGTCAGCCTGAC CTGCCTGGTCAAAGGCTTCTATCCCAGCGACATC GCCGTGGAGTGGGAGAGCAATGGGCAGCCGGAG AACAACTACAAGACCACGCCTCCCGTGCTGAAGT CCGACGGCTCCTTCTTCCTCTATAGCAAGCTCACC GTGGACAAGAGCAGGTGGCAGCAGGGGAACGTC TTCTCATGCTCCGTGATGCATGAGGCTCTGCACAA CCACTACACGCAGAAGAGCCTCTCCCTGTCTCCG GGTAAA (SEQ ID NO: 332) |
| 57B | HC-117 | QVQLVESGGGVVQPGRSL RLSCAASGFTFSSYGMHW VRQAPGKELEWVAVIWY DGSNKYYADSVKGRFIISR DKSKNTLYLQMNSLRAED TAVYYCARAGGIAAAGLY YYYGMDVWGQGTTVTVS SASTKGPSVFPLAPSSKSTS GGTAALGCLVKDYFPEPV TVSWNSGALTSGVHTFPA VLQSSGLYSLESVVTVPSS | CAGGTGCAGCTGGTGGAGTCTGGGGGAGGCGTGG TCCAGCCTGGGAGGTCCCTGAGACTCTCCTGTGC AGCGTCTGGATTCACCTTCAGTAGCTATGGCATGC ACTGGGTCCGCCAGGCTCCAGGGAAGGAGCTGGA GTGGGTGGCAGTTATATGGTATGATGGAAGTAAT AAATACTATGCAGACTCCGTGAAGGGCCGATTCA TCATCTCCAGAGATAAATCCAAGAACACGCTGTA TCTGCAAATGAACAGCCTGAGAGCCGAGGACACG GCTGTGTATTACTGTGCGAGAGCGGGGGGTATAG CAGCAGCTGGCCTCTACTACTACTACGGTATGGA CGTCTGGGGCCAAGGGACAACAGTTACCGTCTCT |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | SLGTQTYICNVNHKPSNTK VDKKVEPKSCDKTHTCPP CPAPELLGGPSVFLFPPKP KDTLMISRTPEVTCVVVD VSHEDPEVKFNWYVDGVE VHNAKTKPCEEQYGSTYR CVSVLTVLHQDWLNGKE YKCKVSNKALPAPIEKTIS KAKGQPREPQVYTLPPSR KEMTKNQVSLTCLVKGFY PSDIAVEWESNGQPENNY KTTPPVLKSDGSFFLYSKL TVDKSRWQQGNVFSCSV MHEALHNHYTQKSLSLSP GK (SEQ ID NO: 311) | AGTGCCTCCACCAAGGGCCCATCGGTCTTCCCCCT GGCACCCTCCTCCAAGAGCACCTCTGGGGGCACA GCGGCCCTGGGCTGCCTGGTCAAGGACTACTTCC CCGAACCGGTGACGGTGTCGTGGAACTCAGGCGC CCTGACCAGCGGCGTGCACACCTTCCCGGCTGTC CTACAGTCCTCAGGACTCTACTCCCTCGAGAGCGT GGTGACCGTGCCCTCCAGCAGCTTGGGCACCCAG ACCTACATCTGCAACGTGAATCACAAGCCCAGCA ACACCAAGGTGGACAAGAAAGTTGAGCCCAAATC TTGTGACAAAACTCACACATGCCCACCGTGCCCA GCACCTGAACTCCTGGGGGGACCGTCAGTCTTCC TCTTCCCCCCAAAACCCAAGGACACCCTCATGAT CTCCCGGACCCCTGAGGTCACATGCGTGGTGGTG GACGTGAGCCACGAAGACCCTGAGGTCAAGTTCA ACTGGTACGTGGACGGCGTGGAGGTGCATAATGC CAAGACAAAGCCGTGCGAGGAGCAGTACGGCAG CACGTACCGTTGCGTCAGCGTCCTCACCGTCCTGC ACCAGGACTGGCTGAATGGCAAGGAGTACAAGTG CAAGGTCTCCAACAAAGCCCTCCCAGCCCCCATC GAGAAAACCATCTCCAAAGCCAAAGGGCAGCCCC GAGAACCACAGGTGTACACCCTGCCCCCATCCCG GAAGGAGATGACCAAGAACCAGGTCAGCCTGAC CTGCCTGGTCAAAGGCTTCTATCCCAGCGACATC GCCGTGGAGTGGGAGAGCAATGGGCAGCCGGAG AACAACTACAAGACCACGCCTCCCGTGCTGAAGT CCGACGGCTCCTTCTTCCTCTATAGCAAGCTCACC GTGGACAAGAGCAGGTGGCAGCAGGGGAACGTC TTCTCATGCTCCGTGATGCATGAGGCTCTGCACAA CCACTACACGCAGAAGAGCCTCTCCCTGTCTCCG GGTAAA (SEQ ID NO: 333) |
| 57C | HC-118 | QVQLVESGGGVVQPGRSL RLSCAASGFTFSSYGMHW VRQAPGKGLEWVAVIWY DGSNKYYADSVKGRFIISR DKSKNTLYLQMNSLRAED TAVYYCARAGGIAAAGLY YYYGMDVWGQGTTVTVS SASTKGPSVFPLAPSSKSTS GGTAALGCLVKDYFPEPV TVSWNSGALTSGVHTFPA VLQSSGLYSLESVVTVPSS SLGTQTYICNVNHKPSNTK VDKKVEPKSCDKTHTCPP CPAPELLGGPSVFLFPPKP KDTLMISRTPEVTCVVVD VSHEDPEVKFNWYVDGVE VHNAKTKPCEEQYGSTYR CVSVLTVLHQDWLNGKE YKCKVSNKALPAPIEKTIS KAKGQPREPQVYTLPPSR KKMTKNQVSLTCLVKGFY PSDIAVEWESNGQPENNY KTTPPVLKSDGSFFLYSKL TVDKSRWQQGNVFSCSV MHEALHNHYTQKSLSL SP GK (SEQ ID NO: 312) | CAGGTGCAGCTGGTGGAGTCTGGGGGAGGCGTGG TCCAGCCTGGGAGGTCCCTGAGACTCTCCTGTGC AGCGTCTGGATTCACCTTCAGTAGCTATGGCATGC ACTGGGTCCGCCAGGCTCCAGGCAAGGGGCTGGA GTGGGTGGCAGTTATATGGTATGATGGAAGTAAT AAATACTATGCAGACTCCGTGAAGGGCCGATTCA TCATCTCCAGAGATAATCCAAGAACACGCTGTA TCTGCAAATGAACAGCCTGAGAGCCGAGGACACG GCTGTGTATTACTGTGCGAGAGCGGGGGTATAG CAGCAGCTGGCCTCTACTACTACGGTATGGA CGTCTGGGGCCAAGGAACAACAGTTACCGTCTCT AGTGCCTCCACCAAGGGCCCATCGGTCTTCCCCCT GGCACCCTCCTCCAAGAGCACCTCTGGGGGCACA GCGGCCCTGGGCTGCCTGGTCAAGGACTACTTCC CCGAACCGGTGACGGTGTCGTGGAACTCAGGCGC CCTGACCAGCGGCGTGCACACCTTCCCGGCTGTC CTACAGTCCTCAGGACTCTACTCCCTCGAGAGCGT GGTGACCGTGCCCTCCAGCAGCTTGGGCACCCAG ACCTACATCTGCAACGTGAATCACAAGCCCAGCA ACACCAAGGTGGACAAGAAAGTTGAGCCCAAATC TTGTGACAAAACTCACACATGCCCACCGTGCCCA GCACCTGAACTCCTGGGGGGACCGTCAGTCTTCC TCTTCCCCCCAAAACCCAAGGACACCCTCATGAT CTCCCGGACCCCTGAGGTCACATGCGTGGTGGTT GACGTGAGCCACGAAGACCCTGAGGTCAAGTTCA ACTGGTACGTGGACGGCGTGGAGGTGCATAATGC CAAGACAAAGCCGTGCGAGGAGCAGTACGGCAG CACGTACCGTTGCGTCAGCGTCCTCACCGTCCTGC ACCAGGACTGGCTGAATGGCAAGGAGTACAAGTG CAAGGTCTCCAACAAAGCCCTCCCAGCCCCCATC GAGAAAACCATCTCCAAAGCCAAAGGGCAGCCCC GAGAACCACAGGTGTACACCCTGCCCCCATCCCG GAAGGAGATGACCAAGAACCAGGTCAGCCTGAC CTGCCTGGTCAAAGGCTTCTATCCCAGCGACATC GCCGTGGAGTGGGAGAGCAATGGGCAGCCGGAG AACAACTACAAGACCACGCCTCCCGTGCTGAAGT CCGACGGCTCCTTCTTCCTCTATAGCAAGCTCACC GTGGACAAGAGCAGGTGGCAGCAGGGGAACGTC TTCTCATGCTCCGTGATGCATGAGGCTCTGCACAA CCACTACACGCAGAAGAGCCTCTCCCTGTCTCCG GGTAAA (SEQ ID NO: 334) |
| 57D | HC-119 | QVQLVESGGGVVQPGRSL RLSCAASGFTFSSYGMHW | CAGGTGCAGCTGGTGGAGTCTGGGGGAGGCGTGG TCCAGCCTGGGAGGTCCCTGAGACTCTCCTGTGC |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | VRQAPGKGLEWVAVIWY DGSNKYYADSVKGRFIISR DKSKNTLYLQMNSLRAED TAVYYCARAGGIAAAGLY YYYGMDVWGQGTTVTVS SASTKGPSVFPLAPCSRSTS ESTAALGCLVKDYFPEPVT VSWNSGALTSGVHTFPAV LQSSGLYSLESVVTVPSSN FGTQTYTCNVDHKPSNTK VDKTVERKCCVECPPCPA PPVAGPSVFLFPPKPKDTL MISRTPEVTCVVVDVSHE DPEVQFNWYVDGVEVHN AKTKPREEQFNSTFRVVSV LTVVHQDWLNGKEYKCK VSNKGLPAPIEKTISKTKG QPREPQVYTLPPSRKKMT KNQVSLTCLVKGFYPSDIA VEWESNGQPENNYKTTPP MLKSDGSFFLYSKLTVDK SRWQQGNVFSCSVMHEAL HNHYTQKSLSLSPGK (SEQ ID NO: 313) | AGCGTCTGGATTCACCTTCAGTAGCTATGGCATGC ACTGGGTCCGCCAGGCTCCAGGCAAGGGGCTGGA GTGGGTGGCAGTTATATGGTATGATGGAAGTAAT AAATACTATGCAGATCCGTGAAGGGCCGATTCA TCATCTCCAGAGATAAATCCAAGAACACGCTGTA TCTGCAAATGAACAGCCTGAGAGCCGAGGACACG GCTGTGTATTACTGTGCGAGAGCGGGGGGTATAG CAGCAGCTGGCCTCTACTACTACTACGGTATGGA CGTCTGGGGCCAAGGGACAACAGTTACCGTCTCT AGTGCCTCCACCAAGGGCCCATCGGTCTTCCCCCT GGCGCCCTGCTCCAGGAGCACCTCCGAGAGCACA CGGCCCTGGGCTGCCTGCTCAAGGACTACTTCC CCGAACCGGTGACGGTGTCGTGGAACTCAGGCGC TCTGACCAGCGGCGTGCACACCTTCCCAGCTGTCC TACAGTCCTCAGGACTCTACTCCCTGGAGAGCGT GGTGACCGTGCCCTCCAGCAACTTCGGCACCCAG ACCTACACCTGCAACGTAGATCACAAGCCCAGCA ACACCAAGGTGGACAAGACAGTTGAGCGCAAAT GTTGTGTCGAGTGCCCACCGTGCCCAGCACCACC TGTGGCAGGACCGTCAGTCTTCCTCTTCCCCCCAA AACCCAAGGACACCCTCATGATCTCCCGGACCCC TGAGGTCACGTGCGTGGTGGTGGACGTGAGCCAC GAAGACCCCGAGGTCCAGTTCAACTGGTACGTGG ACGGCGTGGAGGTGCATAATGCCAAGACAAAGCC ACGGGAGGAGCAGTTCAACAGCACGTTCCGTGTG GTCAGCGTCCTCACCGTTGTGCACCAGGACTGGC TGAACGGCAAGGAGTACAAGTGCAAGGTCTCCAA CAAAGGCCTCCCAGCCCCCATCGAGAAAACCATC TCCAAAACCAAAGGGCAGCCCCGAGAACCACAG GTGTACACCCTGCCCCCATCCCGGAAGAAGATGA CCAAGAACCAGGTCAGCCTGACCTGCCTGGTCAA AGGCTTCTACCCCAGCGACATCGCCGTGGAGTGG GAGAGCAATGGGCAGCCGGAGAACAACTACAAG ACCACACCTCCCATGCTGAAGTCCGACGGCTCCTT CTTCCTCTACAGCAAGCTCACCGTGGACAAGAGC AGGTGGCAGCAGGGGAACGTCTTCTCATGCTCCG TGATGCATGAGGCTCTGCACAACCACTACACGCA GAAGAGCCTCTCCCTGTCTCCGGGTAAA (SEQ ID NO: 335) |
| 58A | HC-120 | QVQLVESGGGVVQPGRSL RLSCAASGFTFSSYGMHW VRQAPGKGLEWVAVIWY DGSNKYYAESVKGRFIISR DKSKNTLYLQMNSLRAED TAVYYCARAGGIAAAGLY YYYGMDVWGQGTTVTVS SASTKGPSVFPLAPSSKSTS GGTAALGCLVKDYFPEPV TVSWNSGALTSGVHTFPA VLQSSGLYSLESVVTVPSS SLGTQTYICNVNHKPSNTK VDKKVEPKSCDKTHTCPP CPAPELLGGPSVFLFPPKP KDTLMISRTPEVTCVVVD VSHEDPEVKFNWYVDGVE VHNAKTKPCEEQYGSTYR CVSVLTVLHQDWLNGKE YKCKVSNKALPAPIEKTIS KAKGQPREPQVYTLPPSR KEMTKNQVSLTCLVKGFY PSDIAVEWESNGQPENNY KTTPPVLKSDGSFFLYSKL TVDKSRWQQGNVFSCSV MHEALHNHYTQKSLSL SP GK (SEQ ID NO: 314) | CAGGTGCAGCTGGTGGAGTCTGGGGGAGGCGTGG TCCAGCCTGGGAGGTCCCTGAGACTCTCCTGTGC AGCGTCTGGATTCACCTTCAGTAGCTATGGCATGC ACTGGGTCCGCCAGGCTCCAGGCAAGGGGCTGGA GTGGGTGGCAGTTATATGGTATGATGGAAGTAAT AAATACTATGCAGAGTCCGTGAAGGGCCGATTCA TCATCTCCAGAGATAAATCCAAGAACACGCTGTA TCTGCAAATGAACAGCCTGAGAGCCGAGGACACG GCTGTGTATTACTGTGCGAGAGCGGGGGGTATAG CAGCAGCTGGCCTCTACTACTACTACGGTATGGA CGTCTGGGGCCAAGGGACAACAGTTACCGTCTCT AGTGCCTCCACCAAGGGCCCATCGGTCTTCCCCCT GGCACCCTCCTCCAAGAGCACCTCTGGGGGCACA GCGGCCCTGGGCTGCCTGGTCAAGGACTACTTCC CCGAACCGGTGACGGTGTCGTGGAACTCAGGCGC CCTGACCAGCGGCGTGCACACCTTCCCGGCTGTC CTACAGTCCTCAGGACTCTACTCCCTGGAGAGCGT GGTGACCGTGCCCTCCAGCAGCTTGGGCACCCAG ACCTACATCTGCAACGTGAATCACAAGCCCAGCA ACACCAAGGTGGACAAGAAAGTTGAGCCCAAATC TTGTGACAAAACTCACACATGCCCACCGTGCCCA GCACCTGAACTCCTGGGGGGACCGTCAGTCTTCC TCTTCCCCCCAAAACCCAAGGACACCCTCATGAT CTCCCGGACCCCTGAGGTCACATGCGTGGTGGTG GACGTGAGCCACGAAGACCCTGAGGTCAAGTTCA ACTGGTACGTGGACGGCGTGGAGGTGCATAATGC CAAGACAAAGCCGTGCGAGGAGCAGTACGGCAG CACGTACCGTTGCGTCAGCGTCCTCACCGTCCTGC ACCAGGACTGGCTGAATGGCAAGGAGTACAAGTG CAAGGTCTCCAACAAAGCCCTCCCAGCCCCCATC GAGAAAACCATCTCCAAAGCCAAAGGGCAGCCCC GAGAACCACAGGTGTACACCCTGCCCCCATCCCG GAAGGAGATGACCAAGAACCAGGTCAGCCTGAC CTGCCTGGTCAAAGGCTTCTATCCCAGCGACATC GCCGTGGAGTGGGAGAGCAATGGGCAGCCGGAG |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | | AACAACTACAAGACCACGCCTCCCGTGCTGAAGT<br>CCGACGGCTCCTTCTTCCTCTATAGCAAGCTCACC<br>GTGGACAAGAGCAGGTGGCAGCAGGGGAACGTC<br>TTCTCATGCTCCGTGATGCATGAGGCTCTGCACAA<br>CCACTACACGCAGAAGAGCCTCTCCCTGTCTCCG<br>GGTAAA (SEQ ID NO: 336) |
| 58B | HC-121 | QVQLVESGGGVVQPGRSL<br>RLSCAASGFTFSSYGMHW<br>VRQAPGKELEWVAVIWY<br>DGSNKYYAESVKGRFIISR<br>DKSKNTLYLQMNSLRAED<br>TAVYYCARAGGIAAAGLY<br>YYYGMDVWGQGTTVTVS<br>SASTKGPSVFPLAPSSKSTS<br>GGTAALGCLVKDYFPEPV<br>TVSWNSGALTSGVHTFPA<br>VLQSSGLYSLESVVTVPSS<br>SLGTQTYICNVNHKPSNTK<br>VDKKVEPKSCDKTHTCPP<br>CPAPELLGGPSVFLFPPKP<br>KDTLMISRTPEVTCVVVD<br>VSHEDPEVKFNWYVDGVE<br>VHNAKTKPCEEQYGSTYR<br>CVSVLTVLHQDWLNGKE<br>YKCKVSNKALPAPIEKTIS<br>KAKGQPREPQVYTLPPSR<br>KEMTKNQVSLTCLVKGFY<br>PSDIAVEWESNGQPENNY<br>KTTPPVLKSDGSFFLYSKL<br>TVDKSRWQQGNVFSCSV<br>MHEALHNHYTQKSLSLSP<br>GK (SEQ ID NO: 315) | CAGGTGCAGCTGGTGGAGTCTGGGGGAGGCGTGG<br>TCCAGCCTGGGAGGTCCCTGAGACTCTCCTGTGC<br>AGCGTCTGGATTCACCTTCAGTAGCTATGGCATGC<br>ACTGGGTCCGCCAGGCTCCAGGGAAGGAGCTGGA<br>GTGGGTGGCAGTTATATGGTATGATGGAAGTAAT<br>AAATACTATGCAGAGTCCGTGAAGGGCCGATTCA<br>TCATCTCCAGAGATAAATCCAAGAACACGCTGTA<br>TCTGCAAATGAACAGCCTGAGAGCCGAGGACACG<br>GCTGTGTATTACTGTGCGAGAGCGGGGGGTATAG<br>CAGCAGCTGGCCTCTACTACTACTACGGTATGGA<br>CGTCTGGGGCCAAGGGACAACAGTTACCGTCTCT<br>AGTGCCTCCACCAAGGGCCCATCGGTCTTCCCCCT<br>GGCACCCTCCTCCAAGAGCACCTCTGGGGGCACA<br>GCGGCCCTGGGCTGCCTGGTCAAGGACTACTTCC<br>CCGAACCGGTGACGGTGTCGTGGAACTCAGGCGC<br>CCTGACCAGCGGCGTGCACACCTTCCCGGCTGTC<br>CTACAGTCCTCAGGACTCTACTCCCTCGAGAGCGT<br>GGTGACCGTGCCCTCCAGCAGCTTGGGCACCCAG<br>ACCTACATCTGCAACGTGAATCACAAGCCCAGCA<br>ACACCAAGGTGGACAAGAAAGTTGAGCCCAAATC<br>TTGTGACAAAACTCACACATGCCCACCGTGCCCA<br>GCACCTGAACTCCTGGGGGGACCGTCAGTCTTCC<br>TCTTCCCCCCAAAACCCAAGGACACCCTCATGAT<br>CTCCCGGACCCCTGAGGTCACATGCGTGGTGGTG<br>GACGTGAGCCACGAAGACCCTGAGGTCAAGTTCA<br>ACTGGTACGTGGACGGCGTGGAGGTGCATAATGC<br>CAAGACAAAGCCGTGCGAGGAGCAGTACGGCAG<br>CACGTACCGTTGCGTCAGCGTCCTCACCGTCCTGC<br>ACCAGGACTGGCTGAATGGCAAGGAGTACAAGTG<br>CAAGGTCTCCAACAAAGCCCTCCCAGCCCCCATC<br>GAGAAAACCATCTCCAAAGCCAAAGGGCAGCCCC<br>GAGAACCACAGGTGTACACCCTGCCCCCATCCCG<br>GAAGGAGATGACCAAGAACCAGGTCAGCCTGAC<br>CTGCCTGGTCAAAGGCTTCTATCCCAGCGACATC<br>GCCGTGGAGTGGGAGAGCAATGGGCAGCCGGAG<br>AACAACTACAAGACCACGCCTCCCGTGCTGAAGT<br>CCGACGGCTCCTTCTTCCTCTATAGCAAGCTCACC<br>GTGGACAAGAGCAGGTGGCAGCAGGGGAACGTC<br>TTCTCATGCTCCGTGATGCATGAGGCTCTGCACAA<br>CCACTACACGCAGAAGAGCCTCTCCCTGTCTCCG<br>GGTAAA (SEQ ID NO: 337) |
| 58C | HC-122 | QVQLVESGGGVVQPGRSL<br>RLSCAASGFTFSSYGMHW<br>VRQAPGKGLEWVAVIWY<br>DGSNKYYAESVKGRFIISR<br>DKSKNTLYLQMNSLRAED<br>TAVYYCARAGGIAAAGLY<br>YYYGMDVWGQGTTVTVS<br>SASTKGPSVFPLAPSSKSTS<br>GGTAALGCLVKDYFPEPV<br>TVSWNSGALTSGVHTFPA<br>VLQSSGLYSLESVVTVPSS<br>SLGTQTYICNVNHKPSNTK<br>VDKKVEPKSCDKTHTCPP<br>CPAPELLGGPSVFLFPPKP<br>KDTLMISRTPEVTCVVVD<br>VSHEDPEVKFNWYVDGVE<br>VHNAKTKPCEEQYGSTYR<br>CVSVLTVLHQDWLNGKE<br>YKCKVSNKALPAPIEKTIS<br>KAKGQPREPQVYTLPPSR<br>KKMTKNQVSLTCLVKGFY<br>PSDIAVEWESNGQPENNY<br>KTTPPVLKSDGSFFLYSKL<br>TVDKSRWQQGNVFSCSV<br>MHEALHNHYTQKSLSL SP<br>GK (SEQ ID NO: 316) | CAGGTGCAGCTGGTGGAGTCTGGGGGAGGCGTGG<br>TCCAGCCTGGGAGGTCCCTGAGACTCTCCTGTGC<br>AGCGTCTGGATTCACCTTCAGTAGCTATGGCATGC<br>ACTGGGTCCGCCAGGCTCCAGGCAAGGGGCTGGA<br>GTGGGTGGCAGTTATATGGTATGATGGAAGTAAT<br>AAATACTATGCAGAGTCCGTGAAGGGCCGATTCA<br>TCATCTCCAGAGATAAATCCAAGAACACGCTGTA<br>TCTGCAAATGAACAGCCTGAGAGCCGAGGACACG<br>GCTGTGTATTACTGTGCGAGAGCGGGGGGTATAG<br>CAGCAGCTGGCCTCTACTACTACTACGGTATGGA<br>CGTCTGGGGCCAAGGACAACAGTTACCGTCTCT<br>AGTGCCTCCACCAAGGGCCCATCGGTCTTCCCCCT<br>GGCACCCTCCTCCAAGAGCACCTCTGGGGGCACA<br>GCGGCCCTGGGCTGCCTGGTCAAGGACTACTTCC<br>CCGAACCGGTGACGGTGTCGTGGAACTCAGGCGC<br>CCTGACCAGCGGCGTGCACACCTTCCCGGCTGTC<br>CTACAGTCCTCAGGACTCTACTCCCTCGAGAGCGT<br>GGTGACCGTGCCCTCCAGCAGCTTGGGCACCCAG<br>ACCTACATCTGCAACGTGAATCACAAGCCCAGCA<br>ACACCAAGGTGGACAAGAAAGTTGAGCCCAAATC<br>TTGTGACAAAACTCACACATGCCCACCGTGCCCA<br>GCACCTGAACTCCTGGGGGGACCGTCAGTCTTCC<br>TCTTCCCCCCAAAACCCAAGGACACCCTCATGAT<br>CTCCCGGACCCCTGAGGTCACATGCGTGGTGGTT<br>GACGTGAGCCACGAAGACCCTGAGGTCAAGTTCA<br>ACTGGTACGTGGACGGCGTGGAGGTGCATAATGC |

TABLE 7B -continued

Exemplary Anti-CGRP Receptor Heavy Chain Sequences

| Antibody ID. | HC Group | Heavy Chain Amino Acid Sequence | Heavy Chain Nucleic Acid Sequence |
|---|---|---|---|
| | | | CAAGACAAAGCCGTGCGAGGAGCAGTACGGCAG<br>CACGTACCGTTGCGTCAGCGTCCTCACCGTCCTGC<br>ACCAGGACTGGCTGAATGGCAAGGAGTACAAGTG<br>CAAGGTCTCCAACAAAGCCCTCCCAGCCCCCATC<br>GAGAAAACCATCTCCAAAGCCAAAGGGCAGCCCC<br>GAGAACCACAGGTGTACACCCTGCCCCCATCCCG<br>GAAGAAGATGACCAAGAACCAGGTCAGCCTGAC<br>CTGCCTGGTCAAAGGCTTCTATCCCAGCGACATC<br>GCCGTGGAGTGGGAGAGCAATGGGCAGCCGGAG<br>AACAACTACAAGACCACGCCTCCCGTGCTGAAGT<br>CCGACGGCTCCTTCTTCCTCTATAGCAAGCTCACC<br>GTGGACAAGAGCAGGTGGCAGCAGGGGAACGTC<br>TTCTCATGCTCCGTGATGCATGAGGCTCTGCACAA<br>CCACTACACGCAGAAGAGCCTCTCCCTGTCTCCG<br>GGTAAA (SEQ ID NO: 338) |

In some embodiments, the heterodimeric antibody of the invention comprises an anti-CGRP receptor light chain from Table 7A and an anti-CGRP receptor heavy chain from Table 7B. Exemplary pairs of anti-CGRP receptor light and heavy chains that may be incorporated into a heterodimeric antibody include, but are not limited to: LC-101 (SEQ ID NO: 271) and HC-101 (SEQ ID NO: 295); LC-102 (SEQ ID NO: 272) and HC-102 (SEQ ID NO: 296); LC-101 (SEQ ID NO: 271) and HC-103 (SEQ ID NO: 297); LC-101 (SEQ ID NO: 271) and HC-104 (SEQ ID NO: 298); LC-103 (SEQ ID NO: 273) and HC-105 (SEQ ID NO: 299); LC-104 (SEQ ID NO: 274) and HC-106 (SEQ ID NO: 300); LC-103 (SEQ ID NO: 273) and HC-107 (SEQ ID NO: 301); LC-103 (SEQ ID NO: 273) and HC-108 (SEQ ID NO: 302); LC-105 (SEQ ID NO: 275) and HC-109 (SEQ ID NO: 303); LC-106 (SEQ ID NO: 276) and HC-110 (SEQ ID NO: 304); LC-105 (SEQ ID NO: 275) and HC-111 (SEQ ID NO: 305); LC-105 (SEQ ID NO: 275) and HC-112 (SEQ ID NO: 306); LC-105 (SEQ ID NO: 275) and HC-113 (SEQ ID NO: 307); LC-106 (SEQ ID NO: 276) and HC-114 (SEQ ID NO: 308); LC-105 (SEQ ID NO: 275) and HC-115 (SEQ ID NO: 309); LC-107 (SEQ ID NO: 277) and HC-109 (SEQ ID NO: 303); LC-108 (SEQ ID NO: 278) and HC-110 (SEQ ID NO: 304); LC-107 (SEQ ID NO: 277) and HC-111 (SEQ ID NO: 305); LC-109 (SEQ ID NO: 279) and HC-109 (SEQ ID NO: 303); LC-110 (SEQ ID NO: 280) and HC-110 (SEQ ID NO: 304); LC-109 (SEQ ID NO: 279) and HC-111 (SEQ ID NO: 305); LC-107 (SEQ ID NO: 277) and HC-113 (SEQ ID NO: 307); LC-108 (SEQ ID NO: 278) and HC-114 (SEQ ID NO: 308); LC-107 (SEQ ID NO: 277) and HC-115 (SEQ ID NO: 309); LC-111 (SEQ ID NO: 281) and HC-116 (SEQ ID NO: 310); LC-112 (SEQ ID NO: 282) and HC-117 (SEQ ID NO: 311); LC-111 (SEQ ID NO: 281) and HC-118 (SEQ ID NO: 312); LC-111 (SEQ ID NO: 281) and HC-119 (SEQ ID NO: 313); LC-111 (SEQ ID NO: 281) and HC-120 (SEQ ID NO: 314); LC-112 (SEQ ID NO: 282) and HC-121 (SEQ ID NO: 315); and LC-111 (SEQ ID NO: 281) and HC-122 (SEQ ID NO: 316).

The anti-CGRP receptor light chain and/or heavy chain incorporated into a heterodimeric antibody of the invention may comprise a sequence of contiguous amino acids that differs from the sequence of a light chain in Table 7A or a heavy chain in Table 7B by 1, 2, 3, 4, 5, 6, 7, 8, 9, 10, 11, 12, 13, 14, 15 or more amino acid residues, wherein each such sequence difference is independently a deletion, insertion or substitution of one amino acid. In some embodiments, the anti-CGRP receptor light chain incorporated into a heterodimeric antibody comprises a sequence of amino acids that has at least 70%, at least 75%, at least 80%, at least 85%, at least 90%, at least 95%, at least 97% or at least 99% sequence identity to the amino acid sequences of SEQ ID NOs: 271-282 (i.e. the anti-CGRP receptor light chains in Table 7A). In certain embodiments, the anti-CGRP receptor heavy chain incorporated into a heterodimeric antibody comprises a sequence of amino acids that has at least 70%, at least 75%, at least 80%, at least 85%, at least 90%, at least 95%, at least 97% or at least 99% sequence identity to the amino acid sequences of SEQ ID NOs: 295-316 (i.e. the anti-CGRP receptor heavy chains in Table 7B).

Any of the anti-PAC1 receptor light and heavy chains listed in Tables 6A and 6B may be combined with any of the anti-CGRP receptor light and heavy chains listed in Table 7A and 7B to form a bispecific, heterodimeric antibody of the invention. The structural features (e.g. component anti-PAC1 receptor light and heavy chains and anti-CGRP receptor light and heavy chains) of exemplary bispecific, heterodimeric antibodies of the invention are set forth in Table 8 below. These antibodies contain one or more charge pair mutations as described herein to promote correct pairing of heavy and light chains as well as heterodimerization between an anti-PAC1 receptor heavy chain and an anti-CGRP receptor heavy chain. Antibodies having an "A" designation comprise the "v1" electrostatic steering strategy shown in FIG. 1, whereas antibodies having a "B" designation comprise the "v3" electrostatic steering strategy shown in FIG. 1. Antibodies having a "C" or "D" designation comprise the "v4" electrostatic steering strategy shown in FIG. 1, with "C" antibodies having an IgG1 constant domain and "D" antibodies having an IgG2 constant domain. The variable light and heavy chain designations (e.g. LV-01, LV-02, LV-101, LV-102, HV-01, HV-02, HV-101, HV-102, etc.) in Table 8 are defined by amino acid sequence in Tables 1A, 1B, 3A, and 3B and nucleotide sequence in Tables 11 and 12. The light and heavy chain designations (e.g. LC-01, LC-02, LC-101, LC-102, HC-01, HC-02, HC-101, HC-102, etc.) in Table 8 are defined by amino acid and nucleotide sequence in Tables 6A, 6B, 7A, and 7B. Thus, the full sequence information for each of the four chains of the exemplary heterodimeric antibodies in Table 8 can be obtained by cross-reference to these tables. By way of illustration, heterodimeric antibody iPS: 326417 comprises an anti-PAC1 receptor light chain comprising the amino acid sequence of SEQ ID NO: 211 (LC-01), an anti-PAC1 receptor heavy chain comprising the amino acid sequence of SEQ ID NO: 233 (HC-01), an anti-CGRP receptor light chain comprising the amino acid sequence of SEQ ID NO: 281 (LC-111) and an anti-CGRP receptor heavy chain comprising the amino acid sequence of SEQ ID NO: 310 (HC-116).

TABLE 8

Exemplary Anti-PAC1 Receptor/Anti-CGRP Receptor Heterodimeric Antibodies

| Heterodimeric Antibody Designation | Anti-PAC1 Receptor Antibody ID. | Anti-PAC1 Receptor Full Light Chain | Anti-PAC1 Receptor VL | Anti-PAC1 Receptor Full Heavy Chain | Anti-PAC1 Receptor VH | Anti-CGRP Receptor Antibody ID. | Anti-CGRP Receptor Full Light Chain | Anti-CGRP Receptor VL | Anti-CGRP Receptor Full Heavy Chain | Anti-CGRP Receptor VH |
|---|---|---|---|---|---|---|---|---|---|---|
| iPS:326417 | 01A | LC-01 | LV-01 | HC-01 | HV-01 | 57A | LC-111 | LV-111 | HC-116 | HV-109 |
| iPS:326626 | 01D | LC-01 | LV-01 | HC-04 | HV-01 | 50D | LC-101 | LV-101 | HC-104 | HV-101 |
| iPS:326628 | 03D | LC-04 | LV-04 | HC-08 | HV-03 | 50D | LC-101 | LV-101 | HC-104 | HV-101 |
| iPS:326634 | 03D | LC-04 | LV-04 | HC-08 | HV-03 | 51D | LC-103 | LV-103 | HC-108 | HV-103 |
| iPS:327870 | 01D | LC-01 | LV-01 | HC-04 | HV-01 | 52D | LC-105 | LV-105 | HC-112 | HV-105 |
| iPS:327871 | 03D | LC-04 | LV-04 | HC-08 | HV-03 | 52D | LC-105 | LV-105 | HC-112 | HV-105 |
| iPS:326645 | 05D | LC-08 | LV-08 | HC-16 | HV-07 | 50D | LC-101 | LV-101 | HC-104 | HV-101 |
| iPS:326648 | 04D | LC-08 | LV-06 | HC-12 | HV-07 | 50D | LC-101 | LV-101 | HC-104 | HV-101 |
| iPS:326651 | 05D | LC-08 | LV-08 | HC-16 | HV-07 | 51D | LC-103 | LV-103 | HC-108 | HV-103 |
| iPS:326631 | 01D | LC-01 | LV-01 | HC-04 | HV-01 | 51D | LC-103 | LV-103 | HC-108 | HV-103 |
| iPS:326654 | 04D | LC-06 | LV-06 | HC-12 | HV-05 | 51D | LC-103 | LV-103 | HC-108 | HV-103 |
| iPS:328000 | 05D | LC-08 | LV-08 | HC-16 | HV-07 | 52D | LC-105 | LV-105 | HC-112 | HV-105 |
| iPS:328001 | 04D | LC-06 | LV-06 | HC-12 | HV-05 | 52D | LC-105 | LV-105 | HC-112 | HV-105 |
| iPS:326661 | 01D | LC-01 | LV-01 | HC-04 | HV-01 | 57D | LC-111 | LV-111 | HC-119 | HV-109 |
| iPS:326663 | 03D | LC-04 | LV-04 | HC-08 | HV-03 | 57D | LC-111 | LV-111 | HC-119 | HV-109 |
| iPS:326666 | 05D | LC-08 | LV-08 | HC-16 | HV-07 | 57D | LC-111 | LV-111 | HC-119 | HV-109 |
| iPS:326669 | 04D | LC-06 | LV-06 | HC-12 | HV-05 | 57D | LC-111 | LV-111 | HC-119 | HV-109 |
| iPS:327017 | 05A | LC-08 | LV-08 | HC-13 | HV-07 | 57A | LC-111 | LV-111 | HC-116 | HV-109 |
| iPS:327018 | 03A | LC-04 | LV-04 | HC-05 | HV-03 | 57A | LC-111 | LV-111 | HC-116 | HV-109 |
| iPS:327019 | 04A | LC-06 | LV-06 | HC-09 | HV-05 | 57A | LC-111 | LV-111 | HC-116 | HV-109 |
| iPS:327023 | 01B | LC-02 | LV-02 | HC-02 | HV-02 | 57B | LC-111 | LV-112 | HC-117 | HV-110 |
| iPS:327024 | 05B | LC-09 | LV-09 | HC-14 | HV-08 | 57B | LC-111 | LV-112 | HC-117 | HV-110 |
| iPS:327025 | 03B | LC-05 | LV-05 | HC-06 | HV-04 | 57B | LC-111 | LV-112 | HC-117 | HV-110 |
| iPS:327026 | 04B | LC-07 | LV-07 | HC-10 | HV-06 | 57B | LC-111 | LV-112 | HC-117 | HV-110 |
| iPS:327091 | 01C | LC-01 | LV-01 | HC-03 | HV-01 | 57C | LC-111 | LV-111 | HC-118 | HV-109 |
| iPS:327092 | 05C | LC-08 | LV-08 | HC-15 | HV-07 | 57C | LC-111 | LV-111 | HC-118 | HV-109 |
| iPS:327093 | 03C | LC-04 | LV-04 | HC-07 | HV-03 | 57C | LC-111 | LV-111 | HC-118 | HV-109 |
| iPS:327094 | 04C | LC-06 | LV-06 | HC-11 | HV-05 | 57C | LC-111 | LV-111 | HC-118 | HV-109 |
| iPS:326414 | 01A | LC-01 | LV-01 | HC-01 | HV-01 | 50A | LC-101 | LV-101 | HC-101 | HV-101 |
| iPS:327102 | 05A | LC-08 | LV-08 | HC-13 | HV-07 | 50A | LC-101 | LV-101 | HC-101 | HV-101 |
| iPS:327103 | 03A | LC-04 | LV-04 | HC-05 | HV-03 | 50A | LC-101 | LV-101 | HC-101 | HV-101 |
| iPS:327104 | 04A | LC-06 | LV-06 | HC-09 | HV-05 | 50A | LC-101 | LV-101 | HC-101 | HV-101 |
| iPS:327105 | 01B | LC-02 | LV-02 | HC-02 | HV-02 | 50B | LC-102 | LV-102 | HC-102 | HV-102 |
| iPS:327106 | 05B | LC-09 | LV-09 | HC-14 | HV-08 | 50B | LC-102 | LV-102 | HC-102 | HV-102 |
| iPS:327107 | 03B | LC-05 | LV-05 | HC-06 | HV-04 | 50B | LC-102 | LV-102 | HC-102 | HV-102 |
| iPS:327108 | 04B | LC-07 | LV-07 | HC-10 | HV-06 | 50B | LC-102 | LV-102 | HC-102 | HV-102 |
| iPS:327109 | 01C | LC-01 | LV-01 | HC-03 | HV-01 | 50C | LC-101 | LV-101 | HC-103 | HV-101 |
| iPS:327110 | 05C | LC-08 | LV-08 | HC-15 | HV-07 | 50C | LC-101 | LV-101 | HC-103 | HV-101 |
| iPS:327111 | 03C | LC-04 | LV-04 | HC-07 | HV-03 | 50C | LC-101 | LV-101 | HC-103 | HV-101 |
| iPS:327112 | 04C | LC-06 | LV-06 | HC-11 | HV-05 | 50C | LC-101 | LV-101 | HC-103 | HV-101 |
| iPS:327267 | 01A | LC-01 | LV-01 | HC-01 | HV-01 | 51A | LC-103 | LV-103 | HC-105 | HV-103 |
| iPS:327268 | 05A | LC-08 | LV-08 | HC-13 | HV-07 | 51A | LC-103 | LV-103 | HC-105 | HV-103 |
| iPS:327269 | 03A | LC-04 | LV-04 | HC-05 | HV-03 | 51A | LC-103 | LV-103 | HC-105 | HV-103 |
| iPS:327270 | 04A | LC-06 | LV-06 | HC-09 | HV-05 | 51A | LC-103 | LV-103 | HC-105 | HV-103 |
| iPS:327272 | 01B | LC-02 | LV-02 | HC-02 | HV-02 | 51B | LC-104 | LV-104 | HC-106 | HV-104 |

TABLE 8-continued

Exemplary Anti-PAC1 Receptor/Anti-CGRP Receptor Heterodimeric Antibodies

| Heterodimeric Antibody Designation | Anti-PAC1 Receptor Antibody ID. | Anti-PAC1 Receptor Full Light Chain | Anti-PAC1 Receptor VL | Anti-PAC1 Receptor Full Heavy Chain | Anti-PAC1 Receptor VH | Anti-CGRP Receptor Antibody ID. | Anti-CGRP Receptor Full Light Chain | Anti-CGRP Receptor VL | Anti-CGRP Receptor Full Heavy Chain | Anti-CGRP Receptor VH |
|---|---|---|---|---|---|---|---|---|---|---|
| iPS:327273 | 05B | LC-09 | LV-09 | HC-14 | HV-08 | 51B | LC-104 | LV-104 | HC-106 | HV-104 |
| iPS:327274 | 03B | LC-05 | LV-05 | HC-06 | HV-04 | 51B | LC-104 | LV-104 | HC-106 | HV-104 |
| iPS:327275 | 04B | LC-07 | LV-07 | HC-10 | HV-06 | 51B | LC-104 | LV-104 | HC-106 | HV-104 |
| iPS:327276 | 01C | LC-01 | LV-01 | HC-03 | HV-01 | 51C | LC-103 | LV-103 | HC-107 | HV-103 |
| iPS:327277 | 05C | LC-08 | LV-08 | HC-15 | HV-07 | 51C | LC-103 | LV-103 | HC-107 | HV-103 |
| iPS:327278 | 03C | LC-04 | LV-04 | HC-07 | HV-03 | 51C | LC-103 | LV-103 | HC-107 | HV-103 |
| iPS:327279 | 04C | LC-06 | LV-06 | HC-11 | HV-05 | 51C | LC-103 | LV-103 | HC-107 | HV-103 |
| iPS:327280 | 01A | LC-01 | LV-01 | HC-01 | HV-01 | 52A | LC-105 | LV-105 | HC-109 | HV-105 |
| iPS:327281 | 05A | LC-08 | LV-08 | HC-13 | HV-07 | 52A | LC-105 | LV-105 | HC-109 | HV-105 |
| iPS:327282 | 03A | LC-04 | LV-04 | HC-05 | HV-03 | 52A | LC-105 | LV-105 | HC-109 | HV-105 |
| iPS:327283 | 04A | LC-06 | LV-06 | HC-09 | HV-05 | 52A | LC-105 | LV-105 | HC-109 | HV-105 |
| iPS:327284 | 01B | LC-02 | LV-02 | HC-02 | HV-02 | 52B | LC-106 | LV-106 | HC-110 | HV-106 |
| iPS:327285 | 05B | LC-09 | LV-09 | HC-14 | HV-08 | 52B | LC-106 | LV-106 | HC-110 | HV-106 |
| iPS:327286 | 03B | LC-05 | LV-05 | HC-06 | HV-04 | 52B | LC-106 | LV-106 | HC-110 | HV-106 |
| iPS:327287 | 04B | LC-07 | LV-07 | HC-10 | HV-06 | 52B | LC-106 | LV-106 | HC-110 | HV-106 |
| iPS:327288 | 01C | LC-01 | LV-01 | HC-03 | HV-01 | 52C | LC-105 | LV-105 | HC-111 | HV-105 |
| iPS:327289 | 05C | LC-08 | LV-08 | HC-15 | HV-07 | 52C | LC-105 | LV-105 | HC-111 | HV-105 |
| iPS:327290 | 03C | LC-04 | LV-04 | HC-07 | HV-03 | 52C | LC-105 | LV-105 | HC-111 | HV-105 |
| iPS:327291 | 04C | LC-06 | LV-06 | HC-11 | HV-05 | 52C | LC-105 | LV-105 | HC-111 | HV-105 |
| iPS:327677 | 01A | LC-01 | LV-01 | HC-01 | HV-01 | 58A | LC-111 | LV-111 | HC-120 | HV-111 |
| iPS:327678 | 05A | LC-08 | LV-08 | HC-13 | HV-07 | 58A | LC-111 | LV-111 | HC-120 | HV-111 |
| iPS:327679 | 03A | LC-04 | LV-04 | HC-05 | HV-03 | 58A | LC-111 | LV-111 | HC-120 | HV-111 |
| iPS:327680 | 04A | LC-06 | LV-06 | HC-09 | HV-05 | 58A | LC-111 | LV-111 | HC-120 | HV-111 |
| iPS:327681 | 01B | LC-02 | LV-02 | HC-02 | HV-02 | 58B | LC-112 | LV-112 | HC-121 | HV-112 |
| iPS:327682 | 05B | LC-09 | LV-09 | HC-14 | HV-08 | 58B | LC-112 | LV-112 | HC-121 | HV-112 |
| iPS:327683 | 03B | LC-05 | LV-05 | HC-06 | HV-04 | 58B | LC-112 | LV-112 | HC-121 | HV-112 |
| iPS:327684 | 04B | LC-07 | LV-07 | HC-10 | HV-06 | 58B | LC-112 | LV-112 | HC-121 | HV-112 |
| iPS:327685 | 01C | LC-01 | LV-01 | HC-03 | HV-01 | 58C | LC-111 | LV-111 | HC-122 | HV-111 |
| iPS:327686 | 05C | LC-08 | LV-08 | HC-15 | HV-07 | 58C | LC-111 | LV-111 | HC-122 | HV-111 |
| iPS:327687 | 03C | LC-04 | LV-04 | HC-07 | HV-03 | 58C | LC-111 | LV-111 | HC-122 | HV-111 |
| iPS:327688 | 04C | LC-06 | LV-06 | HC-11 | HV-05 | 58C | LC-111 | LV-111 | HC-122 | HV-111 |
| iPS:327689 | 01A | LC-01 | LV-01 | HC-01 | HV-01 | 53A | LC-105 | LV-105 | HC-113 | HV-107 |
| iPS:327690 | 05A | LC-08 | LV-08 | HC-13 | HV-07 | 53A | LC-105 | LV-105 | HC-113 | HV-107 |
| iPS:327691 | 03A | LC-04 | LV-04 | HC-05 | HV-03 | 53A | LC-105 | LV-105 | HC-113 | HV-107 |
| iPS:327693 | 04A | LC-06 | LV-06 | HC-09 | HV-05 | 53A | LC-105 | LV-105 | HC-113 | HV-107 |
| iPS:327694 | 01B | LC-02 | LV-02 | HC-02 | HV-02 | 53B | LC-106 | LV-106 | HC-114 | HV-108 |
| iPS:327696 | 05B | LC-09 | LV-09 | HC-14 | HV-08 | 53B | LC-106 | LV-106 | HC-114 | HV-108 |
| iPS:327697 | 03B | LC-05 | LV-05 | HC-06 | HV-04 | 53B | LC-106 | LV-106 | HC-114 | HV-108 |
| iPS:327698 | 04B | LC-07 | LV-07 | HC-10 | HV-06 | 53B | LC-106 | LV-106 | HC-114 | HV-108 |
| iPS:327699 | 01C | LC-01 | LV-01 | HC-03 | HV-01 | 53C | LC-105 | LV-105 | HC-115 | HV-107 |
| iPS:327700 | 05C | LC-08 | LV-08 | HC-15 | HV-07 | 53C | LC-105 | LV-105 | HC-115 | HV-107 |
| iPS:327701 | 03C | LC-04 | LV-04 | HC-07 | HV-03 | 53C | LC-105 | LV-105 | HC-115 | HV-107 |
| iPS:327702 | 04C | LC-06 | LV-06 | HC-11 | HV-05 | 53C | LC-105 | LV-105 | HC-115 | HV-107 |
| iPS:327703 | 01A | LC-01 | LV-01 | HC-01 | HV-01 | 54A | LC-107 | LV-107 | HC-109 | HV-105 |
| iPS:327704 | 05A | LC-08 | LV-08 | HC-13 | HV-07 | 54A | LC-107 | LV-107 | HC-109 | HV-105 |
| iPS:327705 | 03A | LC-04 | LV-04 | HC-05 | HV-03 | 54A | LC-107 | LV-107 | HC-109 | HV-105 |
| iPS:327706 | 04A | LC-06 | LV-06 | HC-09 | HV-05 | 54A | LC-107 | LV-107 | HC-109 | HV-105 |

TABLE 8-continued

Exemplary Anti-PAC1 Receptor/Anti-CGRP Receptor Heterodimeric Antibodies

| Heterodimeric Antibody Designation | Anti-PAC1 Receptor Antibody ID. | Anti-PAC1 Receptor Full Light Chain | Anti-PAC1 Receptor VL | Anti-PAC1 Receptor Full Heavy Chain | Anti-PAC1 Receptor VH | Anti-CGRP Receptor Antibody ID. | Anti-CGRP Receptor Full Light Chain | Anti-CGRP Receptor VL | Anti-CGRP Receptor Full Heavy Chain | Anti-CGRP Receptor VH |
|---|---|---|---|---|---|---|---|---|---|---|
| iPS:327707 | 01B | LC-02 | LV-02 | HC-02 | HV-02 | 54B | LC-108 | LV-108 | HC-110 | HV-106 |
| iPS:327708 | 05B | LC-09 | LV-09 | HC-14 | HV-08 | 54B | LC-108 | LV-108 | HC-110 | HV-106 |
| iPS:327709 | 03B | LC-05 | LV-05 | HC-06 | HV-04 | 54B | LC-108 | LV-108 | HC-110 | HV-106 |
| iPS:327710 | 04B | LC-07 | LV-07 | HC-10 | HV-06 | 54B | LC-108 | LV-108 | HC-110 | HV-105 |
| iPS:327711 | 01C | LC-01 | LV-01 | HC-03 | HV-01 | 54C | LC-107 | LV-107 | HC-111 | HV-105 |
| iPS:327712 | 05C | LC-08 | LV-08 | HC-15 | HV-07 | 54C | LC-107 | LV-107 | HC-111 | HV-105 |
| iPS:327713 | 03C | LC-04 | LV-04 | HC-07 | HV-03 | 54C | LC-107 | LV-107 | HC-111 | HV-105 |
| iPS:327714 | 04C | LC-06 | LV-06 | HC-11 | HV-05 | 54C | LC-107 | LV-107 | HC-111 | HV-105 |
| iPS:327717 | 01A | LC-01 | LV-01 | HC-01 | HV-01 | 55A | LC-109 | LV-109 | HC-109 | HV-105 |
| iPS:327718 | 05A | LC-08 | LV-08 | HC-13 | HV-07 | 55A | LC-109 | LV-109 | HC-109 | HV-105 |
| iPS:327719 | 03A | LC-04 | LV-04 | HC-05 | HV-03 | 55A | LC-109 | LV-109 | HC-109 | HV-105 |
| iPS:327721 | 04A | LC-06 | LV-06 | HC-09 | HV-05 | 55A | LC-109 | LV-109 | HC-109 | HV-105 |
| iPS:327722 | 01B | LC-02 | LV-02 | HC-02 | HV-02 | 55B | LC-110 | LV-110 | HC-110 | HV-106 |
| iPS:327724 | 05B | LC-09 | LV-09 | HC-14 | HV-08 | 55B | LC-110 | LV-110 | HC-110 | HV-106 |
| iPS:327725 | 03B | LC-05 | LV-05 | HC-06 | HV-04 | 55B | LC-110 | LV-110 | HC-110 | HV-106 |
| iPS:327726 | 04B | LC-07 | LV-07 | HC-10 | HV-06 | 55B | LC-110 | LV-110 | HC-110 | HV-106 |
| iPS:327727 | 01C | LC-01 | LV-01 | HC-03 | HV-01 | 55C | LC-109 | LV-109 | HC-111 | HV-105 |
| iPS:327728 | 05C | LC-08 | LV-08 | HC-15 | HV-07 | 55C | LC-109 | LV-109 | HC-111 | HV-105 |
| iPS:327729 | 03C | LC-04 | LV-04 | HC-07 | HV-03 | 55C | LC-109 | LV-109 | HC-111 | HV-105 |
| iPS:327730 | 04C | LC-06 | LV-06 | HC-11 | HV-05 | 55C | LC-109 | LV-109 | HC-111 | HV-105 |
| iPS:327731 | 01A | LC-01 | LV-01 | HC-01 | HV-01 | 56A | LC-107 | LV-107 | HC-111 | LV-107 |
| iPS:327732 | 05A | LC-08 | LV-08 | HC-13 | HV-07 | 56A | LC-107 | LV-107 | HC-113 | LV-107 |
| iPS:327733 | 03A | LC-04 | LV-04 | HC-05 | HV-03 | 56A | LC-107 | LV-107 | HC-113 | LV-107 |
| iPS:327734 | 04A | LC-06 | LV-06 | HC-09 | HV-05 | 56A | LC-107 | LV-107 | HC-113 | LV-107 |
| iPS:327735 | 01B | LC-02 | LV-02 | HC-02 | HV-02 | 56B | LC-108 | LV-108 | HC-114 | LV-108 |
| iPS:327736 | 05B | LC-09 | LV-09 | HC-14 | HV-08 | 56B | LC-108 | LV-108 | HC-114 | LV-108 |
| iPS:327737 | 03B | LC-05 | LV-05 | HC-06 | HV-04 | 56B | LC-108 | LV-108 | HC-114 | LV-108 |
| iPS:327738 | 04B | LC-07 | LV-07 | HC-10 | HV-06 | 56B | LC-108 | LV-108 | HC-114 | LV-108 |
| iPS:327739 | 01C | LC-01 | LV-01 | HC-03 | HV-01 | 56C | LC-107 | LV-107 | HC-115 | LV-107 |
| iPS:327740 | 05C | LC-08 | LV-08 | HC-15 | HV-07 | 56C | LC-107 | LV-107 | HC-115 | LV-107 |
| iPS:327741 | 03C | LC-04 | LV-04 | HC-07 | HV-03 | 56C | LC-107 | LV-107 | HC-115 | LV-107 |
| iPS:327742 | 04C | LC-06 | LV-06 | HC-11 | HV-05 | 56C | LC-107 | LV-107 | HC-115 | LV-107 |
| iPS:327872 | 02A | LC-03 | LV-03 | HC-01 | HV-01 | 58A | LC-111 | LV-111 | HC-120 | HV-111 |
| iPS:327874 | 06A | LC-10 | LV-10 | HC-17 | HV-09 | 58A | LC-111 | LV-111 | HC-120 | HV-111 |
| iPS:327875 | 02B | LC-03 | LV-03 | HC-18 | HV-10 | 58B | LC-112 | LV-112 | HC-121 | HV-112 |
| iPS:327876 | 06B | LC-10 | LV-10 | HC-03 | HV-01 | 58C | LC-111 | LV-111 | HC-122 | HV-111 |
| iPS:327877 | 02C | LC-03 | LV-03 | HC-19 | HV-11 | 58C | LC-111 | LV-111 | HC-122 | HV-111 |
| iPS:327878 | 06C | LC-10 | LV-10 | HC-01 | HV-01 | 53A | LC-105 | LV-105 | HC-113 | HV-107 |
| iPS:327879 | 02A | LC-03 | LV-03 | HC-17 | HV-09 | 53A | LC-105 | LV-105 | HC-113 | HV-107 |
| iPS:327880 | 06A | LC-10 | LV-10 | HC-18 | HV-10 | 53B | LC-106 | LV-106 | HC-114 | HV-108 |
| iPS:327881 | 06B | LC-11 | LC-11 | HC-03 | HV-01 | 53C | LC-105 | LV-105 | HC-115 | HV-107 |
| iPS:327882 | 02C | LC-03 | LV-03 | HC-19 | HV-11 | 53C | LC-105 | LV-105 | HC-115 | HV-107 |
| iPS:327883 | 06C | LC-10 | LV-10 | HC-01 | HV-01 | 54A | LC-107 | LV-107 | HC-109 | HV-105 |
| iPS:327884 | 02A | LC-03 | LV-03 | HC-17 | HV-09 | 54A | LC-107 | LV-107 | HC-109 | HV-105 |
| iPS:327885 | 06A | LC-10 | LV-10 | HC-18 | HV-10 | 54B | LC-108 | LV-108 | HC-110 | HV-106 |
| iPS:327886 | 02C | LC-11 | LV-11 | HC-03 | HV-01 | 54C | LC-107 | LV-107 | HC-111 | HV-105 |
| iPS:327887 | 06C | LC-10 | LV-10 | HC-19 | HV-09 | 54C | LC-107 | LV-107 | HC-111 | HV-105 |

TABLE 8-continued

Exemplary Anti-PAC1 Receptor/Anti-CGRP Receptor Heterodimeric Antibodies

| Heterodimeric Antibody Designation | Anti-PAC1 Receptor Antibody ID. | Anti-PAC1 Receptor Full Light Chain | Anti-PAC1 Receptor VL | Anti-PAC1 Receptor Full Heavy Chain | Anti-PAC1 Receptor VH | Anti-CGRP Receptor Antibody ID. | Anti-CGRP Receptor Full Light Chain | Anti-CGRP Receptor VL | Anti-CGRP Receptor Full Heavy Chain | Anti-CGRP Receptor VH |
|---|---|---|---|---|---|---|---|---|---|---|
| iPS327888 | 02A | LC-03 | LV-03 | HC-01 | HV-01 | 55A | LC-109 | LV-109 | HC-109 | HV-105 |
| iPS327889 | 06A | LC-10 | LV-10 | HC-17 | HV-09 | 55A | LC-109 | LV-109 | HC-109 | HV-105 |
| iPS327890 | 06B | LC-11 | LV-11 | HC-18 | HV-10 | 55B | LC-110 | LV-110 | HC-110 | HV-106 |
| iPS327891 | 02C | LC-03 | LV-03 | HC-03 | HV-01 | 55C | LC-109 | LV-109 | HC-111 | HV-105 |
| iPS327892 | 06C | LC-10 | LV-10 | HC-19 | HV-09 | 55C | LC-109 | LV-109 | HC-111 | HV-105 |
| iPS327893 | 02A | LC-03 | LV-03 | HC-01 | HV-01 | 56A | LC-107 | LV-107 | HC-113 | LV-107 |
| iPS327894 | 06A | LC-10 | LV-10 | HC-17 | HV-09 | 56A | LC-107 | LV-107 | HC-113 | LV-107 |
| iPS327895 | 06B | LC-11 | LV-11 | HC-18 | HV-10 | 56B | LC-108 | LV-108 | HC-114 | LV-108 |
| iPS327896 | 02C | LC-03 | LV-03 | HC-03 | HV-01 | 56C | LC-107 | LV-107 | HC-115 | LV-107 |
| iPS327897 | 06C | LC-10 | LV-10 | HC-19 | HV-09 | 56C | LC-107 | LV-107 | HC-115 | LV-107 |
| iPS328031 | 02A | LC-03 | LV-03 | HC-01 | HV-01 | 57A | LC-111 | LV-111 | HC-116 | HV-109 |
| iPS328033 | 06A | LC-10 | LV-10 | HC-17 | HV-09 | 57A | LC-111 | LV-111 | HC-116 | HV-109 |
| iPS328034 | 06B | LC-11 | LV-11 | HC-18 | HV-10 | 57B | LC-112 | LV-112 | HC-117 | HV-110 |
| iPS328035 | 02C | LC-03 | LV-03 | HC-03 | HV-01 | 57C | LC-111 | LV-111 | HC-118 | HV-109 |
| iPS328036 | 06C | LC-10 | LV-10 | HC-19 | HV-09 | 57C | LC-111 | LV-111 | HC-118 | HV-109 |
| iPS328037 | 02A | LC-03 | LV-03 | HC-01 | HV-01 | 50A | LC-101 | LV-101 | HC-101 | HV-101 |
| iPS328038 | 06A | LC-10 | LV-10 | HC-17 | HV-09 | 50A | LC-101 | LV-101 | HC-101 | HV-101 |
| iPS328039 | 06B | LC-11 | LV-11 | HC-18 | HV-10 | 50B | LC-102 | LV-102 | HC-102 | HV-102 |
| iPS328040 | 02C | LC-03 | LV-03 | HC-03 | HV-01 | 50C | LC-101 | LV-101 | HC-103 | HV-101 |
| iPS328041 | 06C | LC-10 | LV-10 | HC-19 | HV-09 | 50C | LC-101 | LV-101 | HC-103 | HV-101 |
| iPS328042 | 02A | LC-03 | LV-03 | HC-01 | HV-01 | 51A | LC-103 | LV-103 | HC-105 | HV-103 |
| iPS328043 | 06A | LC-10 | LV-10 | HC-17 | HV-09 | 51A | LC-103 | LV-103 | HC-105 | HV-103 |
| iPS328044 | 06B | LC-11 | LV-11 | HC-18 | HV-10 | 51B | LC-104 | LV-104 | HC-106 | HV-104 |
| iPS328045 | 02C | LC-03 | LV-03 | HC-03 | HV-01 | 51C | LC-103 | LV-103 | HC-107 | HV-103 |
| iPS328046 | 06C | LC-10 | LV-10 | HC-19 | HV-09 | 51C | LC-103 | LV-103 | HC-107 | HV-103 |
| iPS328047 | 02A | LC-03 | LV-03 | HC-01 | HV-01 | 52A | LC-105 | LV-105 | HC-109 | HV-105 |
| iPS328048 | 06A | LC-10 | LV-10 | HC-17 | HV-09 | 52A | LC-105 | LV-105 | HC-109 | HV-105 |
| iPS328049 | 06B | LC-11 | LV-11 | HC-18 | HV-10 | 52B | LC-106 | LV-106 | HC-110 | HV-106 |
| iPS328050 | 02C | LC-03 | LV-03 | HC-03 | HV-01 | 52C | LC-105 | LV-105 | HC-111 | HV-105 |
| iPS328051 | 06C | LC-10 | LV-10 | HC-19 | HV-09 | 52C | LC-105 | LV-105 | HC-111 | HV-105 |

In certain embodiments, the bispecific antigen binding protein of the invention is a heterodimeric antibody selected from the antibodies designated as iPS:326417, iPS:326626, iPS:326628, iPS:326631, iPS:326634, iPS:327870, iPS: 327871, iPS:326645, iPS:326648, iPS:326651, iPS:326654, iPS:328000, iPS:328001, iPS:326661, iPS:326663, iPS: 326666, iPS:326669, iPS:327017, iPS:327018, iPS:327019, iPS:327023, iPS:327024, iPS:327025, iPS:327026, iPS: 327091, iPS:327092, iPS:327093, iPS:327094, iPS:326414, iPS:327102, iPS:327103, iPS:327104, iPS:327105, iPS: 327106, iPS:327107, iPS:327108, iPS:327109, iPS:327110, iPS:327111, iPS:327112, iPS:327267, iPS:327268, iPS: 327269, iPS:327270, iPS:327272, iPS:327273, iPS:327274, iPS:327275, iPS:327276, iPS:327277, iPS:327278, iPS: 327279, iPS:327280, iPS:327281, iPS:327282, iPS:327283, iPS:327284, iPS:327285, iPS:327286, iPS:327287, iPS: 327288, iPS:327289, iPS:327290, iPS:327291, iPS:327677, iPS:327678, iPS:327679, iPS:327680, iPS:327681, iPS: 327682, iPS:327683, iPS:327684, iPS:327685, iPS:327686, iPS:327687, iPS:327688, iPS:327689, iPS:327690, iPS: 327691, iPS:327693, iPS:327694, iPS:327696, iPS:327697, iPS:327698, iPS:327699, iPS:327700, iPS:327701, iPS: 327702, iPS:327703, iPS:327704, iPS:327705, iPS:327706, iPS:327707, iPS:327708, iPS:327709, iPS:327710, iPS: 327711, iPS:327712, iPS:327713, iPS:327714, iPS:327717, iPS:327718, iPS:327719, iPS:327721, iPS:327722, iPS: 327724, iPS:327725, iPS:327726, iPS:327727, iPS:327728, iPS:327729, iPS:327730, iPS:327731, iPS:327732, iPS: 327733, iPS:327734, iPS:327735, iPS:327736, iPS:327737, iPS:327738, iPS:327739, iPS:327740, iPS:327741, iPS: 327742, iPS:327872, iPS:327874, iPS:327875, iPS:327876, iPS:327877, iPS:327878, iPS:327879, iPS:327880, iPS: 327881, iPS:327882, iPS:327883, iPS:327884, iPS:327885, iPS:327886, iPS:327887, iPS:327888, iPS:327889, iPS: 327890, iPS:327891, iPS:327892, iPS:327893, iPS:327894, iPS:327895, iPS:327896, iPS:327897, iPS:328031, iPS: 328033, iPS:328034, iPS:328035, iPS:328036, iPS:328037, iPS:328038, iPS:328039, iPS:328040, iPS:328041, iPS: 328042, iPS:328043, iPS:328044, iPS:328045, iPS:328046, iPS:328047, iPS:328048, iPS:328049, iPS:328050, or iPS: 328051 as set forth in Table 8. In some embodiments, the heterodimeric antibody is an antibody selected from the antibodies designated as iPS:327730, iPS:327680, iPS: 328001, iPS:327741, iPS:326648, iPS:327689, iPS:327111, iPS:327742, iPS:327698, iPS:327272, iPS:327717, iPS: 327702, iPS:327270, iPS:327026, iPS:327112, iPS:327283, iPS:327688, or iPS:327714 as set forth in Table 8. In other embodiments, the heterodimeric antibody is an antibody selected from the antibodies designated as iPS:327730, iPS:327680, iPS: 328001, iPS:327741, iPS:326648, iPS: 327689, iPS:327111, iPS:327742, iPS:327698, iPS:327272, iPS:327717, iPS:327702, or iPS:327270 as set forth in Table 8. In particular embodiments, the heterodimeric antibody is an antibody designated as iPS:327689 or iPS:327742 as set forth in Table 8.

The inventive heterodimeric antibodies also encompass antibodies comprising the heavy chain(s) and/or light chain(s) described herein, where one, two, three, four or five amino acid residues are lacking from the N-terminus or C-terminus, or both, in relation to any one of the heavy and light chains set forth in Tables 6A, 6B, 7A, and 7B, e.g., due to post-translational modifications resulting from the type of host cell in which the antibodies are expressed. For instance, Chinese Hamster Ovary (CHO) cells frequently cleave off a C-terminal lysine from antibody heavy chains.

In certain embodiments, the antigen binding proteins of the invention comprise (i) a first binding domain that specifically binds to human CGRP receptor, (ii) a second binding domain that specifically binds to human PAC1 receptor, and (iii) a human immunoglobulin Fc region, wherein one of the binding domains is positioned at the amino terminus of the Fc region and the other binding domain is positioned at the carboxyl terminus of the Fc region. In some such embodiments, each of the first and second binding domains comprises immunoglobulin variable regions. For instance, in certain embodiments, the first binding domain comprises a first light chain variable region (VL1) and a first heavy chain variable region (VH1) from an anti-CGRP receptor antibody and the second binding domain comprises a second light chain variable region (VL2) and a second heavy chain variable region (VH2) from an anti-PAC1 receptor antibody.

As used herein, the term "Fc region" refers to the C-terminal region of an immunoglobulin heavy chain which may be generated by papain digestion of an intact antibody. The Fc region of an immunoglobulin generally comprises two constant domains, a CH2 domain and a CH3 domain, and optionally comprises a CH4 domain. In certain embodiments, the Fc region is an Fc region from an IgG1, IgG2, IgG3, or IgG4 immunoglobulin. In some embodiments, the Fc region comprises CH2 and CH3 domains from a human IgG1 or human IgG2 immunoglobulin. The Fc region may retain effector function, such as C1q binding, complement dependent cytotoxicity (CDC), Fc receptor binding, antibody-dependent cell-mediated cytotoxicity (ADCC), and phagocytosis. In other embodiments, the Fc region may be modified to reduce or eliminate effector function as described in further detail herein.

In some embodiments of the antigen binding proteins of the invention, the binding domain positioned at the carboxyl terminus of the Fc region (i.e. the carboxyl-terminal binding domain) is a scFv. In certain embodiments, the scFv comprises a heavy chain variable region (VH) and light chain variable region (VL) connected by a peptide linker. The variable regions may be oriented within the scFv in a VH-VL or VL-VH orientation. For instance, in one embodiment, the scFv comprises, from N-terminus to C-terminus, a VH region, a peptide linker, and a VL region. In another embodiment, the scFv comprises, from N-terminus to C-terminus, a VL region, a peptide linker, and a VH region. The VH and VL regions of the scFv may contain one or more cysteine substitutions to permit disulfide bond formation between the VH and VL regions. Such cysteine clamps stabilize the two variable domains in the antigen-binding configuration. In one embodiment, position 44 (Kabat numbering) in the VH region and position 100 (Kabat numbering) in the VL region are each substituted with a cysteine residue.

In certain embodiments, the scFv is fused or otherwise connected at its amino terminus to the carboxyl terminus of the Fc region (e.g. the carboxyl terminus of the CH3 domain) through a peptide linker. Thus, in one embodiment, the scFv is fused to an Fc region such that the resulting fusion protein comprises, from N-terminus to C-terminus, a CH2 domain, a CH3 domain, a first peptide linker, a VH region, a second peptide linker, and a VL region. In another embodiment, the scFv is fused to an Fc region such that the resulting fusion protein comprises, from N-terminus to C-terminus, a CH2 domain, a CH3 domain, a first peptide linker, a VL region, a second peptide linker, and a VH region. A "fusion protein" is a protein that includes polypeptide components derived from more than one parental protein or polypeptide. Typically, a fusion protein is expressed from a fusion gene in which a nucleotide sequence encoding a polypeptide sequence from one protein is appended in frame with, and optionally separated by a linker from, a nucleotide sequence encoding a polypeptide sequence from a different protein. The fusion gene can then be expressed by a recombinant host cell to produce the single fusion protein.

A "peptide linker" refers to an oligopeptide of about 2 to about 50 amino acids that covalently joins one polypeptide to another polypeptide. The peptide linkers can be used to connect the VH and VL domains within the scFv. The peptide linkers can also be used to connect a scFv, Fab fragment, or other functional antibody fragment to the amino terminus or carboxyl terminus of an Fc region to create bispecific antigen binding proteins as described herein. Preferably, the peptide linkers are at least 5 amino acids in length. In certain embodiments, the peptide linkers are from about 5 amino acids in length to about 40 amino acids in length. In other embodiments, the peptide linkers are from about 8 amino acids in length to about 30 amino acids in length. In still other embodiments, the peptide linkers are from about 10 amino acids in length to about 20 amino acids in length.

Preferably, but not necessarily, the peptide linker comprises amino acids from among the twenty canonical amino acids, particularly cysteine, glycine, alanine, proline, asparagine, glutamine, and/or serine. In certain embodiments, the peptide linker is comprised of a majority of amino acids that are sterically unhindered, such as glycine, serine, and alanine. Thus, linkers that are preferred in some embodiments, include polyglycines, polyserines, and polyalanines, or combinations of any of these. Some exemplary peptide linkers include, but are not limited to, poly(Gly)$_{2-8}$, particularly (Gly)$_3$, (Gly)$_4$ (SEQ ID NO: 362), (Gly)$_5$ (SEQ ID NO: 363) and (Gly)$_7$ (SEQ ID NO: 364), as well as, poly(Gly)$_4$Ser (SEQ ID NO: 365), poly(Gly-Ala)$_{2-4}$ and poly(Ala)$_{2-8}$. In certain embodiments, the peptide linker is (Gly$_x$Ser)$_n$ where x=3 or 4 and n=2, 3, 4, 5 or 6. Such peptide linkers include "L5" (GGGGS; or "G4S"; SEQ ID NO: 366), "L9" (GGGSGGGGS; or "G3SG4S"; SEQ ID NO: 367), "L10" (GGGGSGGGGS; or "(G4S)$_2$"; SEQ ID NO: 368), "L15" (GGGGSGGGGSGGGGS; or "(G4S)$_3$"; SEQ ID NO: 369), and "L25" (GGGGSGGGGSGGGGSGGGGSGGGGS; or "(G4S)$_5$"; SEQ ID NO:370). In some embodiments, the peptide linker joining the VH and VL regions within the scFv is a L15 or (G4S)$_3$ linker (SEQ ID NO: 369). In these and other embodiments, the peptide linker joining the carboxyl-terminal binding domain (e.g. scFv or Fab) to the C-terminus of the Fc region is a L9 or G3SG4S linker (SEQ ID NO: 367) or a L10 (G4S)$_2$ linker (SEQ ID NO: 368).

Other specific examples of peptide linkers that may be used in the bispecific antigen binding proteins of the invention include (Gly)$_5$Lys (SEQ ID NO: 371); (Gly)$_5$LysArg (SEQ ID NO: 372); (Gly)$_3$Lys(Gly)$_4$ (SEQ ID NO: 373); (Gly)$_3$AsnGlySer(Gly)$_2$ (SEQ ID NO: 374); (Gly)$_3$Cys (Gly)$_4$ (SEQ ID NO: 375); GlyProAsnGlyGly (SEQ ID NO: 376); GGEGGG (SEQ ID NO: 377); GGEEEGGG (SEQ ID NO: 378); GEEEG (SEQ ID NO: 379); GEEE (SEQ ID NO: 380); GGDGGG (SEQ ID NO: 381); GGDDDGG (SEQ ID NO: 382); GDDDG (SEQ ID NO: 383); GDDD (SEQ ID NO: 384); GGGGSDDSDEGSDGEDGGGGS (SEQ ID NO: 385); WEWEW (SEQ ID NO: 386); FEFEF (SEQ ID NO: 387); EEEWWW (SEQ ID NO: 388); EEEFFF (SEQ ID NO: 389); WWEEEWW (SEQ ID NO: 390); and FFEEEFF (SEQ ID NO: 391).

In certain embodiments of the bispecific antigen binding proteins of the invention, the binding domain positioned at the amino terminus of the Fc region (i.e. the amino-terminal binding domain) is a Fab fragment fused to the amino terminus of the Fc region through a peptide linker described herein or through an immunoglobulin hinge region. An "immunoglobulin hinge region" refers to the amino acid sequence connecting the CH1 domain and the CH2 domain of an immunoglobulin heavy chain. The hinge region of human IgG1 is generally defined as the amino acid sequence from about Glu216 or about Cys226, to about Pro230. Hinge regions of other IgG isotypes may be aligned with the IgG1 sequence by placing the first and last cysteine residues forming inter-heavy chain disulfide bonds in the same positions and are determinable to those of skill in the art. In some embodiments, the amino-terminal binding domain is joined to the amino terminus of the Fc region through a human IgG1 hinge region. In other embodiments, the amino-terminal binding domain is joined to the amino terminus of the Fc region through a human IgG2 hinge region. Preferably, the amino-terminal binding domain (e.g. Fab fragment) is fused to the Fc region through the carboxyl terminus of the CH1 region of the Fab.

Figure 2:
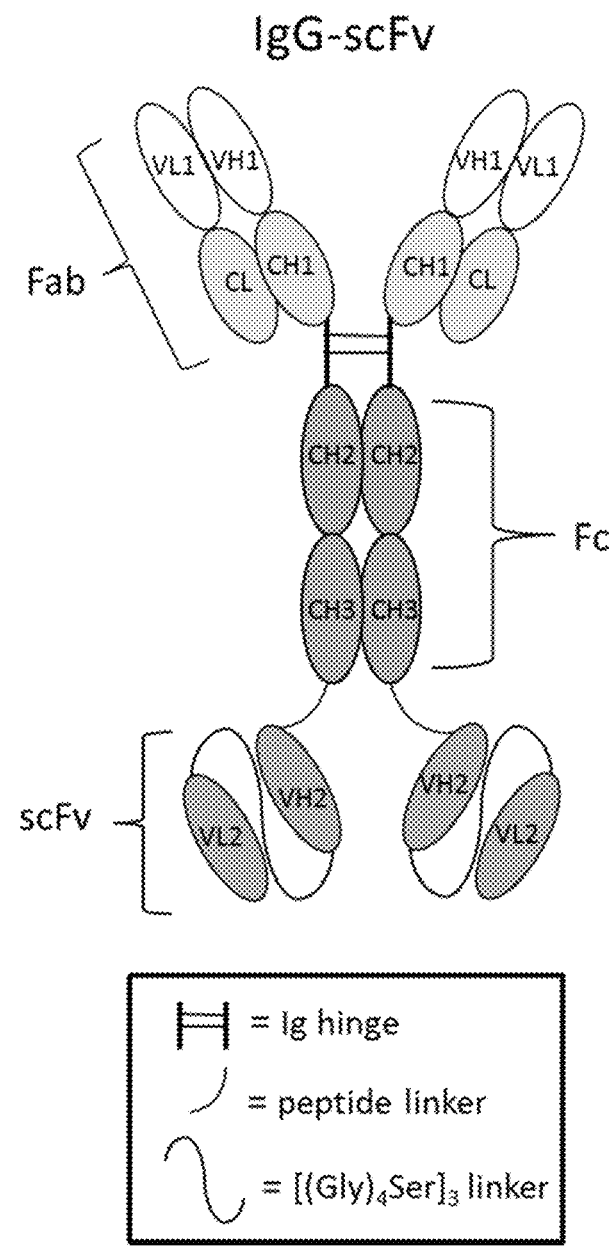
FIG. 2 depicts a schematic representation of an IgG-scFv format used to generate anti-CGRP receptor/PAC1 receptor bispecific antigen binding proteins. In this format, a single-chain variable fragment (scFv), which comprises variable domains from a second antibody linked together by a glycine-serine linker, is fused to the carboxyl terminus of the heavy chain of a first antibody through a peptide linker to produce a modified heavy chain. Although the VH-VL orientation of the variable domains within the scFv is shown, the variable domains may also be organized in a VL-VH orientation. The complete molecule is a homotetramer comprising two modified heavy chains and two light chains from the first antibody.

In some embodiments, the bispecific antigen binding protein of the invention comprises a first antibody that specifically binds to a first target (e.g. human CGRP receptor or human PAC1 receptor) where a scFv comprising variable domains from a second antibody that specifically binds to a second target (e.g. human CGRP receptor or human PAC1 receptor) is fused to the carboxyl terminus of the heavy chain of the first antibody. This format is referred to herein as the "IgG-scFv" format, and one embodiment of this type of molecule is shown schematically in FIG. 2. Thus, in certain embodiments, the present invention includes a bispecific, multivalent antigen binding protein comprising: (i) a light chain and a heavy chain from a first antibody, and (ii) a scFv comprising VL and VH regions from a second antibody, wherein the scFv is fused at its amino terminus to the carboxyl terminus of the heavy chain through a peptide linker to form a modified heavy chain, and wherein the first or second antibody specifically binds to human CGRP receptor and the other antibody specifically binds to human PAC1 receptor. When dimerized, the bispecific antigen binding protein is a homotetramer comprising two light chains and two modified heavy chains.

As used herein, the term "modified heavy chain" refers to a fusion protein comprising an immunoglobulin heavy chain, particularly a human IgG1 or human IgG2 heavy chain, and a functional antibody fragment (e.g. scFv, Fab) or portion thereof (e.g. immunoglobulin light chain or Fd fragment), wherein the fragment or portion thereof is fused at its N-terminus, optionally through a peptide linker, to the C-terminus of the heavy chain.

In the IgG-scFv format of the bispecific antigen binding proteins of the invention, an anti-PAC1 receptor antibody can be the first antibody (i.e. the "IgG") or the second antibody (i.e. from which the scFv is derived). Similarly, an anti-CGRP receptor antibody can be the first antibody (i.e. the "IgG") or the second antibody (i.e. from which the scFv is derived). Any of the anti-PAC1 receptor antibody variable regions set forth in Tables 1A and 1B can be incorporated into either the IgG component or the scFv component of the bispecific antigen binding proteins of the invention. Any of the anti-CGRP receptor antibody variable regions set forth in Tables 3A and 3B can be incorporated into either the IgG component or the scFv component of the bispecific antigen binding proteins of the invention.

Amino acid sequences for light chains and modified heavy chains of exemplary antigen binding proteins of the invention in the IgG-scFv format are summarized in Table 9 below. The molecules listed in the first half of the table comprise an anti-PAC1 receptor IgG component and an anti-CGRP receptor scFv, whereas the molecules listed in the second half of the table comprise an anti-CGRP receptor IgG component and an anti-PAC1 receptor scFv.

TABLE 9

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| Anti-PAC1 Receptor IgG x Anti-CGRP Receptor scFv ||||
| iPS:386738 | DIQLTQSPSFLSASVGD RVTITCRASQSIGRSLH WYQQKPGKAPKLLIK YASQSLSGVPSRFSGS GSGTEFTLTISSLQPED FATYYCHQSSRLPFTF GPGTKVDIKRTVAAPS VFIFPPSDEQLKSGTAS VVCLLNNFYPREAKV QWKVDNALQSGNSQE SVTEQDSKDSTYSLSS TLTLSKADYEKHKVY ACEVTHQGLSSPVTKS FNRGEC (SEQ ID NO: 392) | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQVQLVE SGGGGVVQPGRSLRLSCAASGFTFSSFGMHWVRQAPGKCLEW VAVISFDGSIKYSVDSVKGRFTISRDNSKNTLFLQMNSLRAEDT AVYYCARDRLNYYDSSGYYHYKYYGMAVWGQGTTVTVSSG GGGSGGGGSGGGGSQSVLTQPPSVSAAPGQKVTISCSGSSSNI GNNYVSWYQQLPGTAPKLLIYDNNKRPSGIPDRFSGSKSGTST TLGITGLQTGDEADYYCGTWDSRLSAVVFGCGTKLTVL (SEQ ID NO: 396) |
| iPS:386764 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQSVLTQ PPSVSAAPGQKVTISCSGSSSNIGNNYVSWYQQLPGTAPKLLIY DNNKRPSGIPDRFSGSKSGTSATLGITGLQTGDEADYYCGTWD SRLSAVVFGGGTKLTVLGGGGSGGGGSGGGGSQVQLVESGG GVVQPGRSLRLSCAASGFTFSSFGMHWVRQAPGKGLEWVAVI SFDGSIKYSVDSVKGRFTISRDNSKNTLFLQMNSLRAEDTAVY YCARDRLNYYDSSGYYHYKYYGMAVWGQGTTVTVSS (SEQ ID NO: 397) |
| iPS:386762 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQSVLTQ PPSVSAAPGQKVTISCSGSSSNIGNNYVSWYQQLPGTAPKLLIY DNNKRPSGIPDRFSGSKSGTSATLAITGLQTGDEADYYCGTWD SRLSAVVFGGGTKLTVLGGGGSGGGGSGGGGSQVQLVESGG GVVQPGRSLRLSCAASGFTFSSFGMHWVRQAPGKGLEWVAVI SFDGSIKYSVDSVKGRFTISRDNSKNTLFLQMNSLRAEDTAVY YCARDRLNYYDSSGYYHYKYYGMAVWGQGTTVTVSS (SEQ ID NO: 398) |
| iPS:386760 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI |

TABLE 9-continued

Amino Acid Sequences of Exemplary Bispecific Antigen Binding
Proteins in the IgG-scFv Format

| IgG-scFv Molecule Designation | Light Chain Amino Acid Sequence | Modified Heavy Chain Amino Acid Sequence |
|---|---|---|
| | | AVEWESNGQPENNYKTTPPVLDSDGSFFLYSKLTVDKSRWQQ
GNVFSCSVMHEALHNHYTQKSLSLSPGGGGSGGGGSQSVLTQ
PPSVSAAPGQKVTISCSGSSSNIGNNYVSWYQQLPGTAPKLLIY
DNNKRPSGIPDRFSGSKSGTSATLGITGLQTGDEADYYCGTWD
SRLSAVVFGGGTKLTVLGGGGSGGGGSGGGGSQVQLVESGG
GVVQPGRSLRLSCAASGFTFSSFGMHWVRQAPGKGLEWVAVI
SFDGSIKYSVDSVKGRFTISRDNSKNTLFLQMNSLRAEDTAVY
YCARDRLNYYESSGYYHYKYYGMAVWGQGTTVTVSS
(SEQ ID NO: 399) |
| iPS:386758 | SEQ ID NO: 392 | QVQLVESGAEVVKPGASVKVSCKASGFTFSRFAMHWVRQAP
GQGLEWMGVISYDGGNKYYAESVKGRVTMTRDTSTSTLYME
LSSLRSEDTAVYYCARGYDVLTGYPDYWGQGTLVTVSSASTK
GPSVFPLAPSSKSTSGGTAALGCLVKDYFPEPVTVSWNSGALT
SGVHTFPAVLQSSGLYSLSSVVTVPSSSLGTQTYICNVNHKPSN
TKVDKKVEPKSCDKTHTCPPCPAPELLGGPSVFLFPPKPKDTL
MISRTPEVTCVVVDVSHEDPEVKFNWYVDGVEVHNAKTKPC
EEQYGSTYRCVSVLTVLHQDWLNGKEYKCKVSNKALPAPIEK
TISKAKGQPREPQVYTLPPSREEMTKNQVSLTCLVKGFYPSDI
AVEWESNGQPENNYKTTPPVLDSDGSFFLYSKLTVDKSRWQQ
GNVFSCSVMHEALHNHYTQKSLSLSPGGGGSGGGGSQSVLTQ
PPSVSAAPGQKVTISCSGSSSNIGNNYVSWYQQLPGTAPKLLIY
DNNKRPSGIPDRFSGSKSGTSTTLGITGLQTGDEADYYCGTWD
SRLSAVVFGGGTKLTVLGGGGSGGGGSGGGGSQVQLVESGG
GVVQPGRSLRLSCAASGFTFSSFGMHWVRQAPGKGLEWVAVI
SFDGSIKYSVDSVKGRFTISRDNSKNTLFLQMNSLRAEDTAVY
YCARDRLNYYESSGYYHYKYYGMAVWGQGTTVTVSS
(SEQ ID NO: 400) |
| iPS:386756 | SEQ ID NO: 392 | QVQLVESGAEVVKPGASVKVSCKASGFTFSRFAMHWVRQAP
GQGLEWMGVISYDGGNKYYAESVKGRVTMTRDTSTSTLYME
LSSLRSEDTAVYYCARGYDVLTGYPDYWGQGTLVTVSSASTK
GPSVFPLAPSSKSTSGGTAALGCLVKDYFPEPVTVSWNSGALT
SGVHTFPAVLQSSGLYSLSSVVTVPSSSLGTQTYICNVNHKPSN
TKVDKKVEPKSCDKTHTCPPCPAPELLGGPSVFLFPPKPKDTL
MISRTPEVTCVVVDVSHEDPEVKFNWYVDGVEVHNAKTKPC
EEQYGSTYRCVSVLTVLHQDWLNGKEYKCKVSNKALPAPIEK
TISKAKGQPREPQVYTLPPSREEMTKNQVSLTCLVKGFYPSDI
AVEWESNGQPENNYKTTPPVLDSDGSFFLYSKLTVDKSRWQQ
GNVFSCSVMHEALHNHYTQKSLSLSPGGGGSGGGGSQSVLTQ
PPSVSAAPGQKVTISCSGSSSNIGNNYVSWYQQLPGTAPKLLIY
DNNKRPSGIPDRFSGSKSGTSTTLGITGLQTGDEADYYCGTWD
SRLSAVVFGGGTKLTVLGGGGSGGGGSGGGGSQVQLVESGG
GVVQPGRSLRLSCAASGFTFSSFGMHWVRQAPGKGLEWVAVI
SFDGSIKYSVDSVKGRFTISRDNSKNTLFLQMNSLRAEDTAVY
YCARDRLNYYDSSGYYHYKYYGMAVWGQGTTVTVSS
(SEQ ID NO: 401) |
| iPS:386754 | SEQ ID NO: 392 | QVQLVESGAEVVKPGASVKVSCKASGFTFSRFAMHWVRQAP
GQGLEWMGVISYDGGNKYYAESVKGRVTMTRDTSTSTLYME
LSSLRSEDTAVYYCARGYDVLTGYPDYWGQGTLVTVSSASTK
GPSVFPLAPSSKSTSGGTAALGCLVKDYFPEPVTVSWNSGALT
SGVHTFPAVLQSSGLYSLSSVVTVPSSSLGTQTYICNVNHKPSN
TKVDKKVEPKSCDKTHTCPPCPAPELLGGPSVFLFPPKPKDTL
MISRTPEVTCVVVDVSHEDPEVKFNWYVDGVEVHNAKTKPC
EEQYGSTYRCVSVLTVLHQDWLNGKEYKCKVSNKALPAPIEK
TISKAKGQPREPQVYTLPPSREEMTKNQVSLTCLVKGFYPSDI
AVEWESNGQPENNYKTTPPVLDSDGSFFLYSKLTVDKSRWQQ
GNVFSCSVMHEALHNHYTQKSLSLSPGGGGSGGGGSQVQLVE
SGGGVVQPGRSLRLSCAASGFTFSSFGMHWVRQAPGKGLEW
VAVISFDGSIKYSVDSVKGRFTISRDNSKNTLFLQMNSLRAEDT
AVYYCARDRLNYYESSGYYHYKYYGMAVWGQGTTVTVSSG
GGGSGGGGSGGGGSQSVLTQPPSVSAAPGQKVTISCSGSSSNI
GNNYVSWYQQLPGTAPKLLIYDNNKRPSGIPDRFSGSKSGTST
TLGITGLQTGDEADYYCGTWDSRLSAVVFGGGTKLTVL
(SEQ ID NO: 402) |
| iPS:386752 | SEQ ID NO: 392 | QVQLVESGAEVVKPGASVKVSCKASGFTFSRFAMHWVRQAP
GQGLEWMGVISYDGGNKYYAESVKGRVTMTRDTSTSTLYME
LSSLRSEDTAVYYCARGYDVLTGYPDYWGQGTLVTVSSASTK
GPSVFPLAPSSKSTSGGTAALGCLVKDYFPEPVTVSWNSGALT
SGVHTFPAVLQSSGLYSLSSVVTVPSSSLGTQTYICNVNHKPSN
TKVDKKVEPKSCDKTHTCPPCPAPELLGGPSVFLFPPKPKDTL |

TABLE 9-continued

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| | | MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQVQLVE SGGGVVQPGRSLRLSCAASGFTFSSFGMHWVRQAPGKGLEW VAVISFDGSIKYSVDSVKGRFTISRDNSKNTLFLQMNSLRAEDT AVYYCARDRLNYYDSSGYYHYKYYGMAVWGQGTTVTSSG GGGSGGGGSGGGGSQSVLTQPPSVSAAPGQKVTISCSGSSSNI GNNYVSWYQQLPGTAPKLLIYDNNKRPSGIPDRFSGSKSGTSA TLGITGLQTGDEADYYCGTWDSRLSAVVFGGGTKLTVL (SEQ ID NO: 403) |
| iPS:386750 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQVQLVE SGGGVVQPGRSLRLSCAASGFTFSSFGMHWVRQAPGKCLEW VAVISFDGSIKYSVDSVKGRFTISRDNSKNTLFLQMNSLRAEDT AVYYCARDRLNYYDSSGYYHYKYYGMAVWGQGTTVTSSG GGGSGGGGSGGGGSQSVLTQPPSVSAAPGQKVTISCSGSSSNI GNNYVSWYQQLPGTAPKLLIYDNNKRPSGIPDRFSGSKSGTSA TLGITGLQTGDEADYYCGTWDSRLSAVVFGCGTKLTVL (SEQ ID NO: 404) |
| iPS:386748 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQVQLVE SGGGVVQPGRSLRLSCAASGFTFSSFGMHWVRQAPGKGLEW VAVISFDGSIKYSVDSVKGRFTISRDNSKNTLFLQMNSLRAEDT AVYYCARDRLNYYESSGYYHYKYYGMAVWGQGTTVTSSG GGGSGGGGSGGGGSQSVLTQPPSVSAAPGQKVTISCSGSSSNI GNNYVSWYQQLPGTAPKLLIYDNNKRPSGIPDRFSGSKSGTSA TLGITGLQTGDEADYYCGTWDSRLSAVVFGGGTKLTVL (SEQ ID NO: 405) |
| iPS:386746 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDI AVEWESNGQPENNYKTTPPVLDSDGSFFLYSKLTVDKSRWQQ GNVFSCSVMHEALHNHYTQKSLSLSPGGGGSGGGGSQVQLVE SGGGVVQPGRSLRLSCAASGFTFSSFGMHWVRQAPGKGLEW VAVISFDGSIKYSVDSVKGRFTISRDNSKNTLFLQMNSLRAEDT AVYYCARDRLNYYDSSGYYHYKYYGMAVWGQGTTVTSSG GGGSGGGGSGGGGSQSVLTQPPSVSAAPGQKVTISCSGSSSNI GNNYVSWYQQLPGTAPKLLIYDNNKRPSGIPDRFSGSKSGTSA TLAITGLQTGDEADYYCGTWDSRLSAVVFGGGTKLTVL (SEQ ID NO: 406) |
| iPS:386744 | SEQ ID NO: 392 | QVQLVESGAEVVKPGASVKVSCKASGFTFSRFAMHWVRQAP GQGLEWMGVISYDGGNKYYAESVKGRVTMTRDTSTSTLYME LSSLRSEDTAVYYCARGYDVLTGYPDYWGQGTLVTVSSASTK |

TABLE 9-continued

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| | | GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPC<br>EEQYGSTYRCVSVLTVLHQDWLNGKEYKCKVSNKALPAPIEK<br>TISKAKGQPREPQVYTLPPSREEMTKNQVSLTCLVKGFYPSDI<br>AVEWESNGQPENNYKTTPPVLDSDGSFFLYSKLTVDKSRWQQ<br>GNVFSCSVMHEALHNHYTQKSLSLSPGGGGSGGGGSQVQLVE<br>SGGGVVQPGRSLRLSCAASGFTFSSFGMHWVRQAPGKCLEW<br>VAVISFDGSIKYSVDSVKGRFTISRDNSKNTLFLQMNSLRAEDT<br>AVYYCARDRLNYYDSSGYYHYKYYGMAVWGQGTTVTVSSG<br>GGGSGGGGSGGGGSQSVLTQPPSVSAAPGQKVTISCSGSSSNI<br>GNNYVSWYQQLPGTAPKLLIYDNNKRPSGIPDRFSGSKSGTSA<br>TLAITGLQTGDEADYYCGTWDSRLSAVVFGCGTKLTVL<br>(SEQ ID NO: 407) |
| iPS:386742 | SEQ ID NO: 392 | QVQLVESGAEVVKPGASVKVSCKASGFTFSRFAMHWVRQAP<br>GQGLEWMGVISYDGGNKYYAESVKGRVTMTRDTSTSTLYME<br>LSSLRSEDTAVYYCARGYDVLTGYPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPC<br>EEQYGSTYRCVSVLTVLHQDWLNGKEYKCKVSNKALPAPIEK<br>TISKAKGQPREPQVYTLPPSREEMTKNQVSLTCLVKGFYPSDI<br>AVEWESNGQPENNYKTTPPVLDSDGSFFLYSKLTVDKSRWQQ<br>GNVFSCSVMHEALHNHYTQKSLSLSPGGGGSGGGGSQVQLVE<br>SGGGVVQPGRSLRLSCAASGFTFSSFGMHWVRQAPGKCLEW<br>VAVISFDGSIKYSVDSVKGRFTISRDNSKNTLFLQMNSLRAEDT<br>AVYYCARDRLNYYESSGYYHYKYYGMAVWGQGTTVTVSSG<br>GGGSGGGGSGGGGSQSVLTQPPSVSAAPGQKVTISCSGSSSNI<br>GNNYVSWYQQLPGTAPKLLIYDNNKRPSGIPDRFSGSKSGTSA<br>TLGITGLQTGDEADYYCGTWDSRLSAVVFGCGTKLTVL<br>(SEQ ID NO: 408) |
| iPS:386740 | SEQ ID NO: 392 | QVQLVESGAEVVKPGASVKVSCKASGFTFSRFAMHWVRQAP<br>GQGLEWMGVISYDGGNKYYAESVKGRVTMTRDTSTSTLYME<br>LSSLRSEDTAVYYCARGYDVLTGYPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPC<br>EEQYGSTYRCVSVLTVLHQDWLNGKEYKCKVSNKALPAPIEK<br>TISKAKGQPREPQVYTLPPSREEMTKNQVSLTCLVKGFYPSDI<br>AVEWESNGQPENNYKTTPPVLDSDGSFFLYSKLTVDKSRWQQ<br>GNVFSCSVMHEALHNHYTQKSLSLSPGGGGSGGGGSQVQLVE<br>SGGGVVQPGRSLRLSCAASGFTFSSFGMHWVRQAPGKCLEW<br>VAVISFDGSIKYSVDSVKGRFTISRDNSKNTLFLQMNSLRAEDT<br>AVYYCARDRLNYYESSGYYHYKYYGMAVWGQGTTVTVSSG<br>GGGSGGGGSGGGGSQSVLTQPPSVSAAPGQKVTISCSGSSSNI<br>GNNYVSWYQQLPGTAPKLLIYDNNKRPSGIPDRFSGSKSGTST<br>TLGITGLQTGDEADYYCGTWDSRLSAVVFGCGTKLTVL<br>(SEQ ID NO: 409) |
| iPS:386736 | SEQ ID NO: 392 | QVQLVESGAEVVKPGASVKVSCKASGFTFSRFAMHWVRQAP<br>GQGLEWMGVISYDGGNKYYAESVKGRVTMTRDTSTSTLYME<br>LSSLRSEDTAVYYCARGYDVLTGYPDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPSN<br>TKVDKKVEPKSCDKTHTCPPCPAPELLGGPSVFLFPPKPKDTL<br>MISRTPEVTCVVVDVSHEDPEVKFNWYVDGVEVHNAKTKPC<br>EEQYGSTYRCVSVLTVLHQDWLNGKEYKCKVSNKALPAPIEK<br>TISKAKGQPREPQVYTLPPSREEMTKNQVSLTCLVKGFYPSDI<br>AVEWESNGQPENNYKTTPPVLDSDGSFFLYSKLTVDKSRWQQ<br>GNVFSCSVMHEALHNHYTQKSLSLSPGGGGSGGGGSQVQLVE<br>SGGGVVQPGRSLRLSCAASGFTFSSFGMHWVRQAPGKGLEW<br>VAVISFDGSIKYSVDSVKGRFTISRDNSKNTLFLQMNSLRAEDT<br>AVYYCARDRLNYYDSSGYYHYKYYGMAVWGQGTTVTVSSG<br>GGGSGGGGSGGGGSQSVLTQPPSVSAAPGQKVTISCSGSSSNI<br>GNNYVSWYQQLPGTAPKLLIYDNNKRPSGIPDRFSGSKSGTST<br>TLGITGLQTGDEADYYCGTWDSRLSAVVFGGGTKLTVL<br>(SEQ ID NO: 410) |

TABLE 9-continued

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| | | Anti-CGRP Receptor IgG x Anti-PAC1 Receptor scFv |
| iPS:386731 | QSVLTQPPSVSAAPGQ KVTISCSGSSSNIGNNY VSWYQQLPGTAPKLLI YDNNKRPSGIPDRFSG SKSGTSTTLGITGLQTG DEADYYCGTWDSRLS AVVFGGGTKLTVLGQ PKANPTVTLFPPSSEEL QANKATLVCLISDFYP GAVTVAWKADGSPVK AGVETTKPSKQSNNK YAASSYLSLTPEQWKS HRSYSCQVTHEGSTVE KTVAPTECS (SEQ ID NO: 393) | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSDIQLTQSPSFLSASVGDRVTITCRASQSIGRSLHWYQQKPG KAPKLLIKYASQSLSGVPSRFSGSGSGTEFTLTISSLQPEDFATY YCHQSSRLPFTFGPGTKVDIKRGGGGSGGGGSGGGGSQVQLV ESGAEVVKPGASVKVSCKASGFTFSRFAMHWVRQAPGQGLE WMGVISYDGGNKYYAESVKGRVTMTRDTSTSTLYMELSSLR SEDTAVYYCARGYDVLTGYPDYWGQGTLVTVSS (SEQ ID NO: 411) |
| iPS:386725 | SEQ ID NO: 393 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYDSSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSDIQLTQSPSFLSASVGDRVTITCRASQSIGRSLHWYQQKPG KAPKLLIKYASQSLSGVPSRFSGSGSGTEFTLTISSLQPEDFATY YCHQSSRLPFTFGPGTKVDIKRGGGGSGGGGSGGGGSQVQLV ESGAEVVKPGASVKVSCKASGFTFSRFAMHWVRQAPGQGLE WMGVISYDGGNKYYAESVKGRVTMTRDTSTSTLYMELSSLR SEDTAVYYCARGYDVLTGYPDYWGQGTLVTVSS (SEQ ID NO: 412) |
| iPS:386717 | SEQ ID NO: 393 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKCPKLLIKYASQSLSGVPSRFSGSGSGTEFT LTISSLQPEDFATYYCHQSSRLPFTFGCGTKVDIKR (SEQ ID NO: 413) |
| iPS:386715 | SEQ ID NO: 393 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYDSSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS |

TABLE 9-continued

Amino Acid Sequences of Exemplary Bispecific Antigen Binding
Proteins in the IgG-scFv Format

| IgG-scFv Molecule Designation | Light Chain Amino Acid Sequence | Modified Heavy Chain Amino Acid Sequence |
|---|---|---|
| | | GGGGSGGGGSGGGGSDIQLTQSPSFLSASVGDRVTITCRASQSI GRSLHWYQQKPGKCPKLLIKYASQSLSGVPSRFSGSGSGTEFT LTISSLQPEDFATYYCHQSSRLPFTFGCGTKVDIKR (SEQ ID NO: 414) |
| iPS:386707 | SEQ ID NO: 393 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKAPKLLIKYASQSLSGVPSRFSGSGSGTEFT LTISSLQPEDFATYYCHQSSRLPFTFGPGTKVDIKR (SEQ ID NO: 415) |
| iPS:386705 | SEQ ID NO: 393 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKAPKLLIKYASQSLSGVPSRFSGSGSGTEFT LTISSLQPEDFATYYCHQSSRLPFTFGPGTKVDIKR (SEQ ID NO: 416) |
| iPS:386723 | QSVLTQPPSVSAAPGQ KVTISCSGSSSNIGNNY VSWYQQLPGTAPKLLI YDNNKRPSGIPDRFSG SKSGTSATLGITGLQT GDEADYYCGTWDSRL SAVVFGGGTKLTVLG QPKANPTVTLFPPSSEE LQANKATLVCLISDFY PGAVTVAWKADGSPV KAGVETTKPSKQSNN KYAASSYLSLTPEQW KSHRSYSCQVTHEGST VEKTVAPTECS (SEQ ID NO: 394) | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKCPKLLIKYASQSLSGVPSRFSGSGSGTEFT LTISSLQPEDFATYYCHQSSRLPFTFGCGTKVDIKR (SEQ ID NO: 417) |
| iPS:386719 | SEQ ID NO: 394 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG |

TABLE 9-continued

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| | | GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKCPKLLIKYASQSLSGVPSRFSGSGSGTEFT LTISSLQPEDFATYYCHQSSRLPFTFGCGTKVDIKR (SEQ ID NO: 418) |
| iPS:386713 | SEQ ID NO: 394 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKAPKLLIKYASQSLSGVPSRFSGSGSGTEFT LTISSLQPEDFATYYCHQSSRLPFTFGPGTKVDIKR (SEQ ID NO: 419) |
| iPS:386709 | SEQ ID NO: 394 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKAPKLLIKYASQSLSGVPSRFSGSGSGTEFT LTISSLQPEDFATYYCHQSSRLPFTFGPGTKVDIKR (SEQ ID NO: 420) |
| iPS:386727 | SEQ ID NO: 394 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSDIQLTQSPSFLSASVGDRVTITCRASQSIGRSLHWYQQKPG KAPKLLIKYASQSLSGVPSRFSGSGSGTEFTLTISSLQPEDFATY YCHQSSRLPFTFGPGTKVDIKRGGGGSGGGGSGGGGSQVQLV ESGAEVVKPGASVKVSCKASGFTFSRFAMHWVRQAPGQGLE WMGVISYDGGNKYYAESVKGRVTMTRDTSTSTLYMELSSLR SEDTAVYYCARGYDVLTGYPDYWGQGTLVTVSS (SEQ ID NO: 421) |
| iPS:386721 | QSVLTQPPSVSAAPGQ KVTISCSGSSSNIGNNY VSWYQQLPGTAPKLLI YDNNKRPSGIPDRFSG SKSGTSATLAITGLQT GDEADYYCGTWDSRL SAVVFGGGTKLTVLG QPKANPTVTLFPPSSEE | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQGTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS |

TABLE 9-continued

Amino Acid Sequences of Exemplary Bispecific Antigen Binding Proteins in the IgG-scFv Format

| IgG-scFv Molecule Designation | Light Chain Amino Acid Sequence | Modified Heavy Chain Amino Acid Sequence |
|---|---|---|
| | LQANKATLVCLISDFY PGAVTVAWKADGSPV KAGVETTKPSKQSNN KYAASSYLSLTPEQW KSHRSYSCQVTHEGST VEKTVAPTECS (SEQ ID NO: 395) | NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKCPKLLIKYASQSLSGVPSRFSGSGSGTEFT LTISSLQPEDFATYYCHQSSRLPFTFGCGTKVDIKR (SEQ ID NO: 422) |
| iPS:386711 | SEQ ID NO: 395 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSQVQLVESGAEVVKPGASVKVSCKASGFTFSRFAMHWVR QAPGQGLEWMGVISYDGGNKYYAESVKGRVTMTRDTSTSTL YMELSSLRSEDTAVYYCARGYDVLTGYPDYWGQGTLVTVSS GGGGSGGGGSGGGGSDIQLTQSPSFLSASVGDRVTITCRASQSI GRSLHWYQQKPGKAPKLLIKYASQSLSGVPSRFSGSGSGTEFT LTISSLQPEDFATYYCHQSSRLPFTFGPGTKVDIKR (SEQ ID NO: 423) |
| iPS:386733 | SEQ ID NO: 395 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYESSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSDIQLTQSPSFLSASVGDRVTITCRASQSIGRSLHWYQQKPG KAPKLLIKYASQSLSGVPSRFSGSGSGTEFTLTISSLQPEDFATY YCHQSSRLPFTFGPGTKVDIKRGGGGSGGGGSGGGGSQVQLV ESGAEVVKPGASVKVSCKASGFTFSRFAMHWVRQAPGQGLE WMGVISYDGGNKYYAESVKGRVTMTRDTSTSTLYMELSSLR SEDTAVYYCARGYDVLTGYPDYWGQGTLVTVSS (SEQ ID NO: 424) |
| iPS:386729 | SEQ ID NO: 395 | QVQLVESGGGVVQPGRSLRLSCAASGFTFSSFGMHWVRQAPG KGLEWVAVISFDGSIKYSVDSVKGRFTISRDNSKNTLFLQMNS LRAEDTAVYYCARDRLNYYDSSGYYHYKYYGMAVWGQTT VTVSSASTKGPSVFPLAPSSKSTSGGTAALGCLVKDYFPEPVT VSWNSGALTSGVHTFPAVLQSSGLYSLSSVVTVPSSSLGTQTY ICNVNHKPSNTKVDKKVEPKSCDKTHTCPPCPAPELLGGPSVF LFPPKPKDTLMISRTPEVTCVVVDVSHEDPEVKFNWYVDGVE VHNAKTKPCEEQYGSTYRCVSVLTVLHQDWLNGKEYKCKVS NKALPAPIEKTISKAKGQPREPQVYTLPPSREEMTKNQVSLTCL VKGFYPSDIAVEWESNGQPENNYKTTPPVLDSDGSFFLYSKLT VDKSRWQQGNVFSCSVMHEALHNHYTQKSLSLSPGGGGSGG GGSDIQLTQSPSFLSASVGDRVTITCRASQSIGRSLHWYQQKPG KAPKLLIKYASQSLSGVPSRFSGSGSGTEFTLTISSLQPEDFATY YCHQSSRLPFTFGPGTKVDIKRGGGGSGGGGSGGGGSQVQLV ESGAEVVKPGASVKVSCKASGFTFSRFAMHWVRQAPGQGLE WMGVISYDGGNKYYAESVKGRVTMTRDTSTSTLYMELSSLR SEDTAVYYCARGYDVLTGYPDYWGQGTLVTVSS (SEQ ID NO: 425) |

In certain embodiments, the first antibody (i.e. the IgG component) of the IgG-scFv bispecific antigen binding proteins is an anti-PAC1 receptor antibody and the second antibody (i.e. from which the scFv is derived) is an anti-CGRP receptor antibody. In such embodiments, the anti-PAC1 receptor antibody comprises a VL region from any of those described in Table 1A and a VH region from any of those described in Table 1B. For instance, in one embodiment, the anti-PAC1 receptor antibody from which the IgG component is derived comprises a LV-04 (SEQ ID NO: 31) VL region and a HV-03 (SEQ ID NO: 85) VH region.

In embodiments in which the scFv component is derived from an anti-CGRP receptor antibody, the anti-CGRP receptor antibody may comprise a VL region from any of those described in Table 3A and a VH region from any of those described in Table 3B. In one embodiment, the anti-CGRP receptor scFv comprises a LV-105 (SEQ ID NO: 140) VL region and a HV-105 (SEQ ID NO: 194) VH region. In another embodiment, the anti-CGRP receptor scFv comprises a LV-105 (SEQ ID NO: 140) VL region and a HV-107 (SEQ ID NO: 196) VH region. In another embodiment, the anti-CGRP receptor scFv comprises a LV-107 (SEQ ID NO: 142) VL region and a HV-105 (SEQ ID NO: 194) VH region. In yet another embodiment, the anti-CGRP receptor scFv comprises a LV-109 (SEQ ID NO: 144) VL region and a HV-105 (SEQ ID NO: 194) VH region. In still another embodiment, the anti-CGRP receptor scFv comprises a LV-107 (SEQ ID NO: 142) VL region and a HV-107 (SEQ ID NO: 196) VH region.

In embodiments in which the IgG component of the bispecific antigen binding proteins is derived from an anti-PAC1 receptor antibody and the scFv component is derived from an anti-CGRP receptor antibody, the modified heavy chain of the bispecific antigen binding proteins comprises a sequence selected from SEQ ID NOs: 396 to 410. In related embodiments, the light chain of the bispecific antigen binding proteins comprises the sequence of SEQ ID NO: 392. In certain embodiments, the bispecific, multivalent antigen binding protein is an antigen binding protein designated as iPS:386738, iPS:386764, iPS:386762, iPS:386760, iPS:386758, iPS:386756, iPS:386754, iPS:386752, iPS:386750, iPS:386748, iPS:386746, iPS:386744, iPS:386742, iPS:386740, or iPS:386736 as set forth in Table 9. In other embodiments, the bispecific, multivalent antigen binding protein is an antigen binding protein designated as iPS:386738, iPS:386754, iPS:386750, iPS:386748, iPS:386746, iPS:386744, iPS:386740, or iPS:386736 as set forth in Table 9. In still other embodiments, the bispecific, multivalent antigen binding protein is an antigen binding protein designated as iPS:386744, iPS:386746, or iPS:386748 as set forth in Table 9.

In other embodiments of the invention, the first antibody (i.e. the IgG component) of the IgG-scFv bispecific antigen binding proteins is an anti-CGRP receptor antibody and the second antibody (i.e. from which the scFv is derived) is an anti-PAC1 receptor antibody. In such embodiments, the anti-CGRP receptor antibody comprises a VL region from any of those described in Table 3A and a VH region from any of those described in Table 3B. For example, in one embodiment, the anti-CGRP receptor antibody from which the IgG component is derived comprises a LV-105 (SEQ ID NO: 140) VL region and a HV-105 (SEQ ID NO: 194) VH region.

In another embodiment, the anti-CGRP receptor antibody from which the IgG component is derived comprises a LV-105 (SEQ ID NO: 140) VL region and a HV-107 (SEQ ID NO: 196) VH region. In another embodiment, the anti-CGRP receptor antibody from which the IgG component is derived comprises a LV-107 (SEQ ID NO: 142) VL region and a HV-105 (SEQ ID NO: 194) VH region. In yet another embodiment, the anti-CGRP receptor antibody from which the IgG component is derived comprises a LV-109 (SEQ ID NO: 144) VL region and a HV-105 (SEQ ID NO: 194) VH region. In still another embodiment, the anti-CGRP receptor antibody from which the IgG component is derived comprises a LV-107 (SEQ ID NO: 142) VL region and a HV-107 (SEQ ID NO: 196) VH region.

In embodiments in which the scFv component is derived from an anti-PAC1 receptor antibody, the anti-PAC1 receptor antibody may comprise a VL region from any of those described in Table 1A and a VH region from any of those described in Table 1B. In one embodiment, the anti-PAC1 receptor scFv comprises a LV-04 (SEQ ID NO: 31) VL region and a HV-03 (SEQ ID NO: 85) VH region.

In embodiments in which the IgG component of the bispecific antigen binding proteins is derived from an anti-CGRP receptor antibody and the scFv component is derived from an anti-PAC1 receptor antibody, the modified heavy chain of the bispecific antigen binding proteins comprises a sequence selected from SEQ ID NOs: 411 to 425. In related embodiments, the light chain of the bispecific antigen binding proteins comprises a sequence selected from SEQ ID NOs: 393 to 395. In one embodiment, the modified heavy chain comprises a sequence selected from SEQ ID NOs: 411 to 416 and the light chain comprises the sequence of SEQ ID NO: 393.

In another embodiment, the modified heavy chain comprises a sequence selected from SEQ ID NOs: 417 to 421 and the light chain comprises the sequence of SEQ ID NO: 394. In yet another embodiment, the modified heavy chain comprises a sequence selected from SEQ ID NOs: 422 to 425 and the light chain comprises the sequence of SEQ ID NO: 395.

In certain embodiments, the bispecific, multivalent antigen binding protein is an antigen binding protein designated as iPS:386731, iPS:386725, iPS:386717, iPS:386715, iPS:386707, iPS:386705, iPS:386723, iPS:386719, iPS:386713, iPS:386709, iPS:386727, iPS:386721, iPS:386711, iPS:386733, or iPS:386729 as set forth in Table 9. In some embodiments, the bispecific, multivalent antigen binding protein is an antigen binding protein designated as iPS:386721, iPS:386723, or iPS:386733 as set forth in Table 9.

In some embodiments of the antigen binding proteins of the invention, the binding domain positioned at the carboxyl terminus of the Fc region (i.e. the carboxyl-terminal binding domain) is a Fab fragment. In such embodiments, the Fab is fused or otherwise connected to the carboxyl terminus of the Fc region (e.g. the carboxyl terminus of the CH3 domain) through a peptide linker through the amino terminus of the VL region or VH region of the Fab fragment. Thus, in one embodiment, the Fab is fused to an Fc region through the amino terminus of the VL region of the Fab such that the resulting fusion protein comprises, from N-terminus to C-terminus, a CH2 domain, a CH3 domain, a peptide linker, a VL region, and a CL region. In another embodiment, the Fab is fused to an Fc region through the amino terminus of the VH region of the Fab such that the resulting fusion protein comprises, from N-terminus to C-terminus, a CH2 domain, a CH3 domain, a peptide linker, a VH region, and a CH1 region.

The peptide linker joining the Fc region to the carboxyl-terminal Fab can be any of the peptide linkers described herein. In particular embodiments, the peptide linker joining the Fc region to the carboxyl-terminal Fab fragment is at least 5 amino acids in length. In other embodiments, the peptide linker joining the Fc region to the carboxyl-terminal Fab fragment is at least 8 amino acids in length. Particularly suitable peptide linkers for joining the Fc region to the carboxyl-terminal Fab fragment are glycine-serine linkers, such as $(Gly_xSer)_n$, where x=3 or 4 and n=2, 3, 4, 5 or 6. In one embodiment, the peptide linker connecting the Fc region to the carboxyl-terminal Fab fragment is a L10 (G4S)$_2$ linker (SEQ ID NO: 368). In another embodiment, the peptide linker connecting the Fc region to the carboxyl-terminal Fab fragment is a L9 or G3SG4S linker (SEQ ID NO: 367).

In some embodiments of the bispecific antigen binding proteins of the invention in which the carboxyl-terminal binding domain is a Fab fragment, the binding domain positioned at the amino terminus of the Fc region (i.e. the amino-terminal binding domain) is also a Fab fragment. The amino-terminal Fab fragment can be fused to the amino terminus of the Fc region through a peptide linker or an immunoglobulin hinge region described herein. In some embodiments, the amino-terminal Fab fragment is joined to the amino terminus of the Fc region through a human IgG1 hinge region. In other embodiments, the amino-terminal Fab fragment is joined to the amino terminus of the Fc region through a human IgG2 hinge region. Preferably, the amino-terminal Fab fragment is fused to the Fc region through the carboxyl terminus of the CH1 region of the Fab.

In some embodiments, the bispecific antigen binding protein of the invention comprises a first antibody that specifically binds to a first target (e.g. human CGRP receptor or human PAC1 receptor) where one polypeptide chain (e.g. the light chain (VL-CL)) of a Fab fragment from a second antibody that specifically binds to a second target (e.g. human CGRP receptor or human PAC1 receptor) is fused to the carboxyl terminus of the heavy chain of the first antibody. The bispecific antigen binding protein in such embodiments also comprises a polypeptide chain containing the other half of the Fab fragment from the second antibody (e.g. the Fd chain (VH-CH1)). This format is referred to herein as the "IgG-Fab" format, and one embodiment of this type of molecule is shown schematically in FIG. 3. Thus, in certain embodiments, the present invention includes a bispecific, multivalent antigen binding protein comprising: (i) a light chain from a first antibody, (ii) a heavy chain from the first antibody, wherein the heavy chain is fused at its carboxyl terminus through a peptide linker to a first polypeptide comprising VL-CL domains or VH-CH1 domains of a second antibody to form a modified heavy chain, and (iii) a second polypeptide comprising VH-CH1 domains or VL-CL domains of the second antibody, wherein the first or second antibody specifically binds to human CGRP receptor and the other antibody specifically binds to human PAC1 receptor. When dimerized, the bispecific antigen binding protein is a homohexamer comprising two modified heavy chains, two light chains from the first antibody, and two polypeptide chains containing the other half of the Fab fragment from the second antibody (either the Fd fragment or light chain). In one embodiment, the first polypeptide, which is fused to the carboxyl terminus of the heavy chain, comprises VL and CL domains from the second antibody, and the second polypeptide comprises VH and CH1 domains from the second antibody. In another embodiment, the first polypeptide, which is fused to the carboxyl terminus of the heavy chain, comprises VH and CH1 domains from the second antibody, and the second polypeptide comprises VL and CL domains from the second antibody.

Charge pair mutations or complimentary amino acid substitutions as described herein can be introduced into the Fab regions of the first antibody (Fab 1) or second antibody (Fab 2) to promote correct heavy chain-light chain pairing. For instance, in some embodiments, the amino acid at Kabat position 38 of the VL domain in Fab 1 is replaced with a negatively-charged amino acid (e.g. glutamic acid) and the amino acid at Kabat position 39 of the VH domain in Fab 1 is replaced with a positively-charged amino acid (e.g. lysine). In other embodiments, the amino acid at Kabat position 38 of the VL domain in Fab 1 is replaced with a positively-charged amino acid (e.g. lysine) and the amino acid at Kabat position 39 of the VH domain in Fab 1 is replaced with a negatively-charged amino acid (e.g. glutamic acid). In certain embodiments, the amino acid at Kabat position 38 of the VL domain in Fab 2 is replaced with a negatively-charged amino acid (e.g. glutamic acid) and the amino acid at Kabat position 39 of the VH domain in Fab 2 is replaced with a positively-charged amino acid (e.g. lysine). In other embodiments, the amino acid at Kabat position 38 of the VL domain in Fab 2 is replaced with a positively-charged amino acid (e.g. lysine) and the amino acid at Kabat position 39 of the VH domain in Fab 2 is replaced with a negatively-charged amino acid (e.g. glutamic acid).

In embodiments in which the VH-CH1 region (i.e. Fd fragment) from the second antibody is fused to the heavy chain of the first antibody, the heavy chain from the first antibody comprises a S183E mutation (EU numbering), the light chain from the first antibody comprises a S176K mutation (EU numbering), the light chain from the second antibody comprises a S176E mutation (EU numbering), and the Fd region from the second antibody (which is fused to the C-terminus of the heavy chain from the first antibody) comprises a S183K mutation (EU numbering). In other embodiments, the heavy chain from the first antibody comprises a G44E mutation (Kabat) and S183E mutation (EU numbering), the light chain from the first antibody comprises a G100K mutation (Kabat) and S176K mutation (EU numbering), the light chain from the second antibody comprises a G100E mutation (Kabat) and S176E mutation (EU numbering), and the Fd region from the second antibody (which is fused to the C-terminus of the heavy chain from the first antibody) comprises a G44K mutation (Kabat) and S183K mutation (EU numbering). The charges in the foregoing examples may be reversed so long as the charge on the corresponding light or heavy chain is also reversed so that the correct heavy/light chain pairs have opposite charges.

Additionally or alternatively, correct heavy-light chain pairing may be facilitated by swapping the CH1 and CL domains in the carboxyl-terminal Fab binding domain. By way of example, the first polypeptide, which is fused to the carboxyl terminus of the heavy chain, may comprise a VL domain and CH1 domain from the second antibody, and the second polypeptide may comprise a VH domain and CL domain from the second antibody. In another embodiment, the first polypeptide, which is fused to the carboxyl terminus of the heavy chain, may comprise a VH domain and a CL domain from the second antibody, and the second polypeptide may comprise a VL domain and CH1 domain from the second antibody.

In the IgG-Fab format of the bispecific antigen binding proteins of the invention, an anti-PAC1 receptor antibody can be the first antibody (i.e. the "IgG") or the second antibody (i.e. from which the C-terminal Fab is derived). Similarly, an anti-CGRP receptor antibody can be the first antibody (i.e. the "IgG") or the second antibody (i.e. from which the C-terminal Fab is derived). Any of the anti-PAC1 receptor antibody variable regions set forth in Tables 1A and 1B can be incorporated into either the IgG component or the C-terminal Fab component of the bispecific antigen binding proteins of the invention. Any of the anti-CGRP receptor antibody variable regions set forth in Tables 3A and 3B can be incorporated into either the IgG component or the C-terminal Fab component of the bispecific antigen binding proteins of the invention.

Amino acid sequences for light chains, modified heavy chains, and second polypeptides of exemplary antigen binding proteins of the invention in the IgG-Fab format are summarized in Table 10 below. The molecules listed in the first half of the table comprise an anti-PAC1 receptor IgG component and an anti-CGRP receptor C-terminal Fab fragment, whereas the molecules listed in the second half of the table comprise an anti-CGRP receptor IgG component and an anti-PAC1 receptor C-terminal Fab fragment.

TABLE 10

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| Anti-PAC1 Receptor IgG x Anti-CGRP Receptor Fab ||||
| iPS:392513 | DIQLTQSPSFLSA SVGDRVTITCRAS QSIGRSLHWYQQ KPGKAPKLLIKY ASQSLSGVPSRFS GSGSGTEFTLTISS LQPEDFATYYCH QSSRLPFTFGPGT KVDIKRTVAAPS VFIFPPSDEQLKS GTASVVCLLNNF YPREAKVQWKV DNALQSGNSQES VTEQDSKDSTYS LESTLTLSKADYE KHKVYACEVTH QGLSSPVTKSFNR GEC (SEQ ID NO: 214) | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD YYCGTWDSRLSAVVFGGGTKLTVLASTKGPS VFPLAPSSKSTSGGTAALGCLVKDYFPEPVTVS WNSGALTSGVHTFPAVLQSSGLYSLKSVVTVP SSSLGTQTYICNVNHKPSNTKVDKKV (SEQ ID NO: 428) | QVQLVESGGGVVQP GRSLRLSCAASGFTF SSFGMHWVRQAPG KGLEWVAVISFDGSI KYSVDSVKGRFTISR DNSKNTLFLQMNSL RAEDTAVYYCARDR LNYYDSSGYYHYKY YGMAVWGQGTTVT VSSGQPKANPTVTLF PPSSEELQANKATLV CLISDFYPGAVTVA WKADGSPVKAGVE TTKPSKQSNNKYAA ESYLSLTPEQWKSH RSYSCQVTHEGSTV EKTVAPIECS (SEQ ID NO: 452) |
| iPS:392514 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLASTKGPS VFPLAPSSKSTSGGTAALGCLVKDYFPEPVTVS WNSGALTSGVHTFPAVLQSSGLYSLKSVVTVP SSSLGTQTYICNVNHKPSNTKVDKKV (SEQ ID NO: 429) | QVQLVESGGGVVQP GRSLRLSCAASGFTF SSFGMHWVREAPGK GLEWVAVISFDGSIK YSVDSVKGRFTISRD NSKNTLFLQMNSLR AEDTAVYYCARDRL NYYDSSGYYHYKY YGMAVWGQGTTVT VSSGQPKANPTVTLF PPSSEELQANKATLV CLISDFYPGAVTVA WKADGSPVKAGVE TTKPSKQSNNKYAA ESYLSLTPEQWKSH RSYSCQVTHEGSTV EKTVAPTECS (SEQ ID NO: 453) |
| iPS:392475 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD | QVQLVESGGGVVQP GRSLRLSCAASGFTF SSFGMHWVRQAPG KGLEWVAVISFDGSI KYSVDSVKGRFTISR DNSKNTLFLQMNSL RAEDTAVYYCARDR LNYYESSGYYHYKY YGMAVWGQGTTVT VSSGQPKANPTVTLF PPSSEELQANKATLV CLISDFYPGAVTVA WKADGSPVKAGVE TTKPSKQSNNKYAA ESYLSLTPEQWKSH RSYSCQVTHEGSTV EKTVAPTECS |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| | | YYCGTWDSRLSAVVFGGGTKLTVLASTKGPS VFPLAPSSKSTSGGTAALGCLVKDYFPEPVTVS WNSGALTSGVHTFPAVLQSSGLYSLKSVVTVP SSSLGTQTYICNVNHKPSNTKVDKKV (SEQ ID NO: 430) | (SEQ ID NO: 454) |
| iPS:392519 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLASTKGPS VFPLAPSSKSTSGGTAALGCLVKDYFPEPVTVS WNSGALTSGVHTFPAVLQSSGLYSLKSVVTVP SSSLGTQTYICNVNHKPSNTKVDKKV (SEQ ID NO: 431) | QVQLVESGGGVVQP GRSLRLSCAASGFTF SSFGMHWVREAPGK GLEWVAVISFDGSIK YSVDSVKGRFTISRD NSKNTLFLQMNSLR AEDTAVYYCARDRL NYYESSGYYHYKYY GMAVWGQGTTVTV SSGQPKANPTVTLFP PSSEELQANKATLV CLISDFYPGAVTVA WKADGSPVKAGVE TTKPSKQSNNKYAA ESYLSLTPEQWKSH RSYSCQVTHEGSTV EKTVAPTECS (SEQ ID NO: 455) |
| iPS:392515 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 432) | QVQLVESGGGVVQP GRSLRLSCAASGFTF SSFGMHWVRQAPG KGLEWVAVISFDGSI KYSVDSVKGRFTISR DNSKNTLFLQMNSL RAEDTAVYYCARDR LNYYDSSGYYHYKY YGMAVWGQGTTVT VSSASTKGPSVFPLA PSSKSTSGGTAALGC LVKDYFPEPVTVSW NSGALTSGVHTFPA VLQSSGLYSLESVVT VPSSSLGTQTYICNV NHKPSNTKVDKKV (SEQ ID NO: 456) |
| iPS:392516 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY | QVQLVESGGGVVQP GRSLRLSCAASGFTF SSFGMHWVREAPGK GLEWVAVISFDGSIK YSVDSVKGRFTISRD NSKNTLFLQMNSLR AEDTAVYYCARDRL NYYDSSGYYHYKY YGMAVWGQGTTVT VSSASTKGPSVFPLA PSSKSTSGGTAALGC LVKDYFPEPVTVSW NSGALTSGVHTFPA VLQSSGLYSLESVVT VPSSSLGTQTYICNV NHKPSNTKVDKKV (SEQ ID NO: 457) |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| | | LSLTPEQWKSHRSYSCQVTHEGSTVEKTVAPT ECS (SEQ ID NO: 433) | |
| iPS:392521 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 434) | QVQLVESGGGVVQP GRSLRLSCAASGFTF SSFGMHWVREAPGK GLEWVAVISFDGSIK YSVDSVKGRFTISRD NSKNTLFLQMNSLR AEDTAVYYCARDRL NYYESSGYYHYKYY GMAVWGQGTTVTV SSASTKGPSVFPLAP SSKSTSGGTAALGCL VKDYFPEPVTVSWN SGALTSGVHTFPAV LQSSGLYSLESVVTV PSSSLGTQTYICNVN HKPSNTKVDKKV (SEQ ID NO: 458) |
| iPS:392520 | SEQ ID NO: 214 | QVQLVESGAEVVKPGASVKVSCKASGFTFSRF AMHWVRQAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 435) | QVQLVESGGGVVQP GRSLRLSCAASGFTF SSFGMHWVRQAPG KGLEWVAVISFDGSI KYSVDSVKGRFTISR DNSKNTLFLQMNSL RAEDTAVYYCARDR LNYYESSGYYHYKY YGMAVWGQGTTVT VSSASTKGPSVFPLA PSSKSTSGGTAALGC LVKDYFPEPVTVSW NSGALTSGVHTFPA VLQSSGLYSLESVVT VPSSSLGTQTYICNV NHKPSNTKVDKKV (SEQ ID NO: 459) |
| iPS:392517 | DIQLTQSPSFLSA SVGDRVTITCRAS QSIGRSLHWYQE KPGKAPKLLIKY ASQSLSGVPSRFS GSGSGTEFTLTISS LQPEDFATYYCH QSSRLPFTFGPGT KVDIKRTVAAPS VFIFPPSDEQLKS GTASVVCLLNNF YPREAKVQWKV DNALQSGNSQES VTEQDSKDSTYS LESTLTLSKADYE KHKVYACEVTH QGLSSPVTKSFNR GEC (SEQ ID NO: 426) | QVQLVESGAEVVKPGASVKVSCKASGFTFSRF AMHWVRKAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 436) | SEQ ID NO: 456 |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
| --- | --- | --- | --- |
| iPS:392518 | SEQ ID NO: 426 | QVQLVESGAEVVKPGASVKVSCKASGFTFSRF AMHWVRKAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 437) | SEQ ID NO: 457 |
| iPS:392522 | SEQ ID NO: 426 | QVQLVESGAEVVKPGASVKVSCKASGFTFSRF AMHWVRKAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQQLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 438) | SEQ ID NO: 459 |
| iPS:392523 | SEQ ID NO: 426 | QVQLVESGAEVVKPGASVKVSCKASGFTFSRF AMHWVRKAPGQGLEWMGVISYDGGNKYYAE SVKGRVTMTRDTSTSTLYMELSSLRSEDTAVY YCARGYDVLTGYPDYWGQGTLVTVSSASTKG PSVFPLAPSSKSTSGGTAALGCLVKDYFPEPVT VSWNSGALTSGVHTFPAVLQSSGLYSLKSVVT VPSSSLGTQTYICNVNHKPSNTKVDKKVEPKS CDKTHTCPPCPAPELLGGPSVFLFPPKPKDTLM ISRTPEVTCVVVDVSHEDPEVKFNWYVDGVEV HNAKTKPCEEQYGSTYRCVSVLTVLHQDWLN GKEYKCKVSNKALPAPIEKTISKAKGQPREPQV YTLPPSREEMTKNQVSLTCLVKGFYPSDIAVE WESNGQPENNYKTTPPVLDSDGSFFLYSKLTV DKSRWQQGNVFSCSVMHEALHNHYTQKSLSL SPGGGGSGGGGSQSVLTQPPSVSAAPGQKVTIS CSGSSSNIGNNYVSWYQKLPGTAPKLLIYDNN KRPSGIPDRFSGSKSGTSTTLGITGLQTGDEAD YYCGTWDSRLSAVVFGGGTKLTVLGQPKANP TVTLFPPSSEELQANKATLVCLISDFYPGAVTV AWKADGSPVKAGVETTKPSKQSNNKYAAKSY LSLTPEQWKSHRSYSCQVTHEGSTVEKTVAPT ECS (SEQ ID NO: 439) | SEQ ID NO: 458 |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| | | Anti-CGRP Receptor IgG x Anti-PAC1 Receptor Fab | |
| iPS:392524 | QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS (SEQ ID NO: 275) | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV (SEQ ID NO: 440) | QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 460) |
| iPS:392525 | SEQ ID NO: 275 | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV (SEQ ID NO: 441) | QVQLVESGAEVVKPGASVKVSCKASGFTFSRFAMHWVRKAPGQGLEWMGVISYDGGNKYYAESVKGRVTMTRDTSTSTLYMELSSLRSEDTAVYYCARGYDVLTGYPDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 461) |
| iPS:392526 | SEQ ID NO: 275 | QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV (SEQ ID NO: 442) | SEQ ID NO: 460 |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| iPS:392527 | SEQ ID NO: 275 | QVQLVESGGGVVQPGRSLRLSCAASGFTFSSF GMHWVRQAPGKGLEWVAVISFDGSIKYSVDS VKGRFTISRDNSKNTLFLQMNSLRAEDTAVYY CARDRLNYYESSGYYHYKYYGMAVWGQGTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQEKPGKAPK LLIKYASQSLSGVPSRFSGSGSGYEFTLTISSLQP EDFATYYCHQSSRLPFTFGPGTKVDIKRASTKG PSVFPLAPSSKSTSGGTAALGCLVKDYFPEPVT VSWNSGALTSGVHTFPAVLQSSGLYSLESVVT VPSSSLGTQTYICNVNHKPSNTKVDKKV (SEQ ID NO: 443) | SEQ ID NO: 461 |
| iPS:392528 | SEQ ID NO: 275 | QVQLVESGGGVVQPGRSLRLSCAASGFTFSSF GMHWVRQAPGKGLEWVAVISFDGSIKYSVDS VKGRFTISRDNSKNTLFLQMNSLRAEDTAVYY CARDRLNYYDSSGYYHYKYYGMAVWGQGTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQQKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 444) | QVQLVESGAEVVKP GASVKVSCKASGFT FSRFAMHWVRQAP GQGLEWMGVISYD GGNKYYAESVKGR VTMTRDTSTSTLYM ELSSLRSEDTAVYYC ARGYDVLTGYPDY WGQGTLVTVSSAST KGPSVFPLAPSSKST SGGTAALGCLVKDY FPEPVTVSWNSGAL TSGVHTFPAVLQSSG LYSLKSVVTVPSSSL GTQTYICNVNHKPS NTKVDKKV (SEQ ID NO: 462) |
| iPS:392529 | SEQ ID NO: 275 | QVQLVESGGGVVQPGRSLRLSCAASGFTFSSF GMHWVRQAPGKGLEWVAVISFDGSIKYSVDS VKGRFTISRDNSKNTLFLQMNSLRAEDTAVYY CARDRLNYYDSSGYYHYKYYGMAVWGQGTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQEKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 445) | QVQLVESGAEVVKP GASVKVSCKASGFT FSRFAMHWVRKAP GQGLEWMGVISYD GGNKYYAESVKGR VTMTRDTSTSTLYM ELSSLRSEDTAVYYC ARGYDVLTGYPDY WGQGTLVTVSSAST KGPSVFPLAPSSKST SGGTAALGCLVKDY FPEPVTVSWNSGAL TSGVHTFPAVLQSSG LYSLKSVVTVPSSSL GTQTYICNVNHKPS NTKVDKKV (SEQ ID NO: 463) |
| iPS:392532 | SEQ ID NO: 275 | QVQLVESGGGVVQPGRSLRLSCAASGFTFSSF GMHWVRQAPGKGLEWVAVISFDGSIKYSVDS VKGRFTISRDNSKNTLFLQMNSLRAEDTAVYY | SEQ ID NO: 462 |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| | | CARDRLNYYESSGYYHYKYYGMAVWGQTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQQKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 446) | |
| iPS:392533 | SEQ ID NO: 275 | QVQLVESGGGVVQPGRSLRLSCAASGFTFSSF GMHWVRQAPGKGLEWVAVISFDGSIKYSVDS VKGRFTISRDNSKNTLFLQMNSLRAEDTAVYY CARDRLNYYESSGYYHYKYYGMAVWGQTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQEKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 447) | SEQ ID NO: 463 |
| iPS:392530 | QSVLTQPPSVSAA PGQKVTISCSGSS SNIGNNYVSWYQ KLPGTAPKLLIYD NNKRPSGIPDRFS GSKSGTSTTLGIT GLQTGDEADYYC GTWDSRLSAVVF GGGTKLTVLGQP KANPTVTLFPPSS EELQANKATLVC LISDFYPGAVTVA WKADGSPVKAG VETTKPSKQSNN KYAAKSYLSLTP EQWKSHRSYSCQ VTHEGSTVEKTV APTECS (SEQ ID NO: 427) | QVQLVESGGGVVQPGRSLRLSCAASGFTFSSF GMHWVREAPGKGLEWVAVISFDGSIKYSVDS VKGRFTISRDNSKNTLFLQMNSLRAEDTAVYY CARDRLNYYDSSGYYHYKYYGMAVWGQTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQQKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 448) | SEQ ID NO: 462 |
| iPS:392531 | SEQ ID NO: 427 | QVQLVESGGGVVQPGRSLRLSCAASGFTFSSF GMHWVREAPGKGLEWVAVISFDGSIKYSVDS VKGRFTISRDNSKNTLFLQMNSLRAEDTAVYY CARDRLNYYDSSGYYHYKYYGMAVWGQTT VTVSSASTKGPSVFPLAPSSKSTSGGTAALGCL VKDYFPEPVTVSWNSGALTSGVHTFPAVLQSS | SEQ ID NO: 463 |

TABLE 10-continued

Amino Acid Sequences of Exemplary Bispecific Antigen Binding Proteins in the IgG-Fab Format

| IgG-Fab Molecule Designation | Light Chain Amino Acid Sequence | Modified Heavy Chain Amino Acid Sequence | Second Polypeptide Amino Acid Sequence |
|---|---|---|---|
| | | GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQEKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 449) | |
| iPS:392534 | SEQ ID NO: 427 | QVQLVESGGGVVQPGRSLRLSCAASGFTFSSF GMHWVREAPGKGLEWVAVISFDGSIKYSVDS VKGRFTISRDNSKNTLFLQMNSLRAEDTAVYY CARDRLNYYESSGYYHYKYYGMAVWGQGTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQQKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 450) | SEQ ID NO: 462 |
| iPS:392535 | SEQ ID NO: 427 | QVQLVESGGGVVQPGRSLRLSCAASGFTFSSF GMHWVREAPGKGLEWVAVISFDGSIKYSVDS VKGRFTISRDNSKNTLFLQMNSLRAEDTAVYY CARDRLNYYESSGYYHYKYYGMAVWGQGTT VTVSSASTKGPSVFPLAPSSKSTSGGTAALGCL VKDYFPEPVTVSWNSGALTSGVHTFPAVLQSS GLYSLESVVTVPSSSLGTQTYICNVNHKPSNTK VDKKVEPKSCDKTHTCPPCPAPELLGGPSVFLF PPKPKDTLMISRTPEVTCVVVDVSHEDPEVKFN WYVDGVEVHNAKTKPCEEQYGSTYRCVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGSF FLYSKLTVDKSRWQQGNVFSCSVMHEALHNH YTQKSLSLSPGGGGSGGGGSDIQLTQSPSFLSA SVGDRVTITCRASQSIGRSLHWYQEKPGKAPK LLIKYASQSLSGVPSRFSGSGSGTEFTLTISSLQP EDFATYYCHQSSRLPFTFGPGTKVDIKRTVAAP SVFIFPPSDEQLKSGTASVVCLLNNFYPREAKV QWKVDNALQSGNSQESVTEQDSKDSTYSLEST LTLSKADYEKHKVYACEVTHQGLSSPVTKSFN RGEC (SEQ ID NO: 451) | SEQ ID NO: 463 |

In certain embodiments, the first antibody (i.e. the IgG component) of the IgG-Fab bispecific antigen binding proteins is an anti-PAC1 receptor antibody and the second antibody (i.e. from which the carboxyl-terminal Fab is derived) is an anti-CGRP receptor antibody. In such embodiments, the anti-PAC1 receptor antibody comprises a VL region from any of those described in Table 1A and a VH region from any of those described in Table 1B. For instance, in one embodiment, the anti-PAC1 receptor antibody from which the IgG component is derived comprises a LV-04 (SEQ ID NO: 31) VL region and a HV-03 (SEQ ID NO: 85) VH region.

In embodiments in which the carboxyl-terminal Fab component is derived from an anti-CGRP receptor antibody, the anti-CGRP receptor antibody may comprise a VL region from any of those described in Table 3A and a VH region from any of those described in Table 3B. In one embodiment, the anti-CGRP receptor Fab comprises a LV-105 (SEQ ID NO: 140) VL region and a HV-105 (SEQ ID NO: 194) VH region. In another embodiment, the anti-CGRP receptor Fab comprises a LV-105 (SEQ ID NO: 140) VL region and a HV-107 (SEQ ID NO: 196) VH region.

In embodiments in which the IgG component of the bispecific antigen binding proteins is derived from an anti-PAC1 receptor antibody and the carboxyl-terminal Fab component is derived from an anti-CGRP receptor antibody, the modified heavy chain of the bispecific antigen binding proteins comprises a sequence selected from SEQ ID NOs: 428 to 439. In related embodiments, the light chain of the bispecific antigen binding proteins comprises the sequence of SEQ ID NO: 214 or SEQ ID NO: 426 and the second polypeptide (which contains the other half of the carboxyl-terminal Fab fragment) comprises a sequence selected from SEQ ID NOs: 452 to 459. In some embodiments, the bispecific, multivalent antigen binding protein comprises a light chain, a modified heavy chain, and a second polypeptide, wherein:

(a) the light chain comprises the sequence of SEQ ID NO: 214, the modified heavy chain comprises the sequence of SEQ ID NO: 428, and the second polypeptide comprises the sequence of SEQ ID NO: 452;

(b) the light chain comprises the sequence of SEQ ID NO: 214, the modified heavy chain comprises the sequence of SEQ ID NO: 429, and the second polypeptide comprises the sequence of SEQ ID NO: 453;

(c) the light chain comprises the sequence of SEQ ID NO: 214, the modified heavy chain comprises the sequence of SEQ ID NO: 430, and the second polypeptide comprises the sequence of SEQ ID NO: 454;

(d) the light chain comprises the sequence of SEQ ID NO: 214, the modified heavy chain comprises the sequence of SEQ ID NO: 431, and the second polypeptide comprises the sequence of SEQ ID NO: 455;

(e) the light chain comprises the sequence of SEQ ID NO: 214, the modified heavy chain comprises the sequence of SEQ ID NO: 432, and the second polypeptide comprises the sequence of SEQ ID NO: 456;

(f) the light chain comprises the sequence of SEQ ID NO: 214, the modified heavy chain comprises the sequence of SEQ ID NO: 433, and the second polypeptide comprises the sequence of SEQ ID NO: 457;

(g) the light chain comprises the sequence of SEQ ID NO: 214, the modified heavy chain comprises the sequence of SEQ ID NO: 434, and the second polypeptide comprises the sequence of SEQ ID NO: 458;

(h) the light chain comprises the sequence of SEQ ID NO: 214, the modified heavy chain comprises the sequence of SEQ ID NO: 435, and the second polypeptide comprises the sequence of SEQ ID NO: 459;

(i) the light chain comprises the sequence of SEQ ID NO: 426, the modified heavy chain comprises the sequence of SEQ ID NO: 436, and the second polypeptide comprises the sequence of SEQ ID NO: 456;

(j) the light chain comprises the sequence of SEQ ID NO: 426, the modified heavy chain comprises the sequence of SEQ ID NO: 437, and the second polypeptide comprises the sequence of SEQ ID NO: 457;

(k) the light chain comprises the sequence of SEQ ID NO: 426, the modified heavy chain comprises the sequence of SEQ ID NO: 438, and the second polypeptide comprises the sequence of SEQ ID NO: 459; or (l) the light chain comprises the sequence of SEQ ID NO: 426, the modified heavy chain comprises the sequence of SEQ ID NO: 439, and the second polypeptide comprises the sequence of SEQ ID NO: 458. In certain embodiments, the bispecific, multivalent antigen binding protein is an antigen binding protein designated as iPS:392513, iPS:392514, iPS:392475, iPS:392519, iPS:392515, iPS:392516, iPS:392521, iPS:392520, iPS:392517, iPS:392518, iPS:392522, or iPS:392523 as set forth in Table 10.

In other embodiments of the invention, the first antibody (i.e. the IgG component) of the IgG-Fab bispecific antigen binding proteins is an anti-CGRP receptor antibody and the second antibody (i.e. from which the carboxyl-terminal Fab is derived) is an anti-PAC1 receptor antibody. In such embodiments, the anti-CGRP receptor antibody comprises a VL region from any of those described in Table 3A and a VH region from any of those described in Table 3B.

For example, in one embodiment, the anti-CGRP receptor antibody from which the IgG component is derived comprises a LV-105 (SEQ ID NO: 140) VL region and a HV-105 (SEQ ID NO: 194) VH region. In another embodiment, the anti-CGRP receptor antibody from which the IgG component is derived comprises a LV-105 (SEQ ID NO: 140) VL region and a HV-107 (SEQ ID NO: 196) VH region. In embodiments in which the carboxyl-terminal Fab component is derived from an anti-PAC1 receptor antibody, the anti-PAC1 receptor antibody may comprise a VL region from any of those described in Table 1A and a VH region from any of those described in Table 1B. In one embodiment, the anti-PAC1 receptor Fab comprises a LV-04 (SEQ ID NO: 31) VL region and a HV-03 (SEQ ID NO: 85) VH region.

In embodiments in which the IgG component of the bispecific antigen binding proteins is derived from an anti-CGRP receptor antibody and the carboxyl-terminal Fab component is derived from an anti-PAC1 receptor antibody, the modified heavy chain of the bispecific antigen binding proteins comprises a sequence selected from SEQ ID NOs: 440 to 451. In related embodiments, the light chain of the bispecific antigen binding proteins comprises the sequence of SEQ ID NO: 275 or SEQ ID NO: 427 and the second polypeptide (which contains the other half of the carboxyl-terminal Fab fragment) comprises a sequence selected from SEQ ID NOs: 460 to 463. In some embodiments, the bispecific, multivalent antigen binding protein comprises a light chain, a modified heavy chain, and a second polypeptide, wherein:

(a) the light chain comprises the sequence of SEQ ID NO: 275, the modified heavy chain comprises the sequence of SEQ ID NO: 440, and the second polypeptide comprises the sequence of SEQ ID NO: 460;

(b) the light chain comprises the sequence of SEQ ID NO: 275, the modified heavy chain comprises the sequence of SEQ ID NO: 441, and the second polypeptide comprises the sequence of SEQ ID NO: 461;

(c) the light chain comprises the sequence of SEQ ID NO: 275, the modified heavy chain comprises the sequence of SEQ ID NO: 442, and the second polypeptide comprises the sequence of SEQ ID NO: 460;

(d) the light chain comprises the sequence of SEQ ID NO: 275, the modified heavy chain comprises the sequence of SEQ ID NO: 443, and the second polypeptide comprises the sequence of SEQ ID NO: 461;

(e) the light chain comprises the sequence of SEQ ID NO: 275, the modified heavy chain comprises the sequence of SEQ ID NO: 444, and the second polypeptide comprises the sequence of SEQ ID NO: 462;

(f) the light chain comprises the sequence of SEQ ID NO: 275, the modified heavy chain comprises the sequence of SEQ ID NO: 445, and the second polypeptide comprises the sequence of SEQ ID NO: 463;

(g) the light chain comprises the sequence of SEQ ID NO: 275, the modified heavy chain comprises the sequence of SEQ ID NO: 446, and the second polypeptide comprises the sequence of SEQ ID NO: 462;

(h) the light chain comprises the sequence of SEQ ID NO: 275, the modified heavy chain comprises the sequence of SEQ ID NO: 447, and the second polypeptide comprises the sequence of SEQ ID NO: 463;

(i) the light chain comprises the sequence of SEQ ID NO: 427, the modified heavy chain comprises the sequence of SEQ ID NO: 448, and the second polypeptide comprises the sequence of SEQ ID NO: 462;

(j) the light chain comprises the sequence of SEQ ID NO: 427, the modified heavy chain comprises the sequence of SEQ ID NO: 449, and the second polypeptide comprises the sequence of SEQ ID NO: 463;

(k) the light chain comprises the sequence of SEQ ID NO: 427, the modified heavy chain comprises the sequence of SEQ ID NO: 450, and the second polypeptide comprises the sequence of SEQ ID NO: 462; or (l) the light chain comprises the sequence of SEQ ID NO: 427, the modified heavy chain comprises the sequence of SEQ ID NO: 451, and the second polypeptide comprises the sequence of SEQ ID NO: 463. In certain embodiments, the bispecific, multivalent antigen binding protein is an antigen binding protein designated as iPS:392524, iPS:392525, iPS:392526, iPS:392527, iPS:392528, iPS:392529, iPS:392532, iPS:392533, iPS:392530, iPS:392531, iPS:392534, or iPS:392535 as set forth in Table 10. In other embodiments, the bispecific, multivalent antigen binding protein is an antigen binding protein designated as iPS:392524, iPS:392525, iPS:392526, iPS:392527, iPS:392532, iPS:392533, iPS:392534, or iPS:392535 as set forth in Table 10.

The heavy chain constant regions or the Fc regions of the bispecific antigen binding proteins described herein may comprise one or more amino acid substitutions that affect the glycosylation and/or effector function of the antigen binding protein. One of the functions of the Fc region of an immunoglobulin is to communicate with the immune system when the immunoglobulin binds its target. This is commonly referred to as "effector function." Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc region to Fc receptors on the surface of cells of the immune system. CDC is mediated through the binding of the Fc with proteins of the complement system, e.g., C1q. In some embodiments, the bispecific antigen binding proteins of the invention comprise one or more amino acid substitutions in the constant region to enhance effector function, including ADCC activity, CDC activity, ADCP activity, and/or the clearance or half-life of the antigen binding protein. Exemplary amino acid substitutions (EU numbering) that can enhance effector function include, but are not limited to, E233L, L234I, L234Y, L235S, G236A, S239D, F243L, F243V, P247I, D280H, K290S, K290E, K290N, K290Y, R292P, E294L, Y296W, S298A, S298D, S298V, S298G, S298T, T299A, Y300L, V305I, Q311M, K326A, K326E, K326W, A330S, A330L, A330M, A330F, I332E, D333A, E333S, E333A, K334A, K334V, A339D, A339Q, P396L, or combinations of any of the foregoing.

In other embodiments, the bispecific antigen binding proteins of the invention comprise one or more amino acid substitutions in the constant region to reduce effector function. Exemplary amino acid substitutions (EU numbering) that can reduce effector function include, but are not limited to, C220S, C226S, C229S, E233P, L234A, L234V, V234A, L234F, L235A, L235E, G237A, P238S, S267E, H268Q, N297A, N297G, V309L, E318A, L328F, A330S, A331 S, P331S or combinations of any of the foregoing.

Glycosylation can contribute to the effector function of antibodies, particularly IgG1 antibodies. Thus, in some embodiments, the bispecific antigen binding proteins of the invention may comprise one or more amino acid substitutions that affect the level or type of glycosylation of the binding proteins. Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

In certain embodiments, glycosylation of the bispecific antigen binding proteins described herein is increased by adding one or more glycosylation sites, e.g., to the Fc region of the binding protein. Addition of glycosylation sites to the antigen binding protein can be conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence may be altered through changes at the DNA level, particularly by mutating the DNA encoding the target polypeptide at preselected bases such that codons are generated that will translate into the desired amino acids.

The invention also encompasses production of bispecific antigen binding protein molecules with altered carbohydrate structure resulting in altered effector activity, including antigen binding proteins with absent or reduced fucosylation that exhibit improved ADCC activity. Various methods are known in the art to reduce or eliminate fucosylation. For example, ADCC effector activity is mediated by binding of the antibody molecule to the FcγRIII receptor, which has been shown to be dependent on the carbohydrate structure of the N-linked glycosylation at the N297 residue of the CH2 domain. Non-fucosylated antibodies bind this receptor with increased affinity and trigger FcγRIII-mediated effector functions more efficiently than native, fucosylated antibodies. For example, recombinant production of non-fucosylated antibody in CHO cells in which the alpha-1,6-fucosyl transferase enzyme has been knocked out results in antibody with 100-fold increased ADCC activity (see Yamane-Ohnuki et al., Biotechnol Bioeng. 87(5):614-22, 2004). Similar effects can be accomplished through decreasing the activity of alpha-1,6-fucosyl transferase enzyme or other enzymes in the fucosylation pathway, e.g., through siRNA or antisense RNA treatment, engineering cell lines to knockout the enzyme(s), or culturing with selective glycosylation inhibitors (see Rothman et al., Mol Immunol. 26(12): 1113-23, 1989). Some host cell strains, e.g. Lec13 or rat hybridoma YB2/0 cell line naturally produce antibodies with lower fucosylation levels (see Shields et al., J Biol Chem. 277(30):26733-40, 2002 and Shinkawa et al., J Biol Chem. 278(5):3466-73, 2003). An increase in the level of bisected carbohydrate, e.g. through recombinantly producing antibody in cells that overexpress GnTIII enzyme, has also been determined to increase ADCC activity (see Umana et al., Nat Biotechnol. 17(2): 176-80, 1999).

In other embodiments, glycosylation of the bispecific antigen binding proteins described herein is decreased or eliminated by removing one or more glycosylation sites, e.g., from the Fc region of the binding protein. Amino acid substitutions that eliminate or alter N-linked glycosylation sites can reduce or eliminate N-linked glycosylation of the antigen binding protein.

In certain embodiments, the bispecific antigen binding proteins described herein comprise a mutation at position N297 (EU numbering), such as N297Q, N297A, or N297G. In one particular embodiment, the bispecific antigen binding proteins of the invention comprise a Fc region from a human IgG1 antibody with a N297G mutation. To improve the stability of molecules comprising a N297 mutation, the Fc region of the molecules may be further engineered. For instance, in some embodiments, one or more amino acids in the Fc region are substituted with cysteine to promote disulfide bond formation in the dimeric state. Residues corresponding to V259, A287, R292, V302, L306, V323, or I332 (EU numbering) of an IgG1 Fc region may thus be substituted with cysteine. Preferably, specific pairs of residues are substituted with cysteine such that they preferentially form a disulfide bond with each other, thus limiting or preventing disulfide bond scrambling. Preferred pairs include, but are not limited to, A287C and L306C, V259C and L306C, R292C and V302C, and V323C and I332C. In particular embodiments, the bispecific antigen binding proteins described herein comprise a Fc region from a human IgG1 antibody with mutations at R292C and V302C. In such embodiments, the Fc region may also comprise a N297G mutation.

Modifications of the bispecific antigen binding proteins of the invention to increase serum half-life also may be desirable, for example, by incorporation of or addition of a salvage receptor binding epitope (e.g., by mutation of the appropriate region or by incorporating the epitope into a peptide tag that is then fused to the antigen binding protein at either end or in the middle, e.g., by DNA or peptide synthesis; see, e.g., WO96/32478) or adding molecules such as PEG or other water soluble polymers, including polysaccharide polymers. The salvage receptor binding epitope preferably constitutes a region wherein any one or more amino acid residues from one or two loops of a Fc region are transferred to an analogous position in the antigen binding protein. Even more preferably, three or more residues from one or two loops of the Fc region are transferred. Still more preferred, the epitope is taken from the CH2 domain of the Fc region (e.g., an IgG Fc region) and transferred to the CH1, CH3, or VH region, or more than one such region, of the antigen binding protein. Alternatively, the epitope is taken from the CH2 domain of the Fc region and transferred to the CL region or VL region, or both, of the antigen binding protein. See International applications WO 97/34631 and WO 96/32478 for a description of Fc variants and their interaction with the salvage receptor.

The present invention includes one or more isolated nucleic acids encoding the bispecific antigen binding proteins and components thereof described herein. Nucleic acid molecules of the invention include DNA and RNA in both single-stranded and double-stranded form, as well as the corresponding complementary sequences. DNA includes, for example, cDNA, genomic DNA, chemically synthesized DNA, DNA amplified by PCR, and combinations thereof. The nucleic acid molecules of the invention include full-length genes or cDNA molecules as well as a combination of fragments thereof. The nucleic acids of the invention are preferentially derived from human sources, but the invention includes those derived from non-human species, as well.

Relevant amino acid sequences from an immunoglobulin or region thereof (e.g. variable region, Fc region, etc.) or polypeptide of interest may be determined by direct protein sequencing, and suitable encoding nucleotide sequences can be designed according to a universal codon table. Alternatively, genomic or cDNA encoding monoclonal antibodies from which the binding domains of the bispecific antigen binding proteins of the invention may be derived can be isolated and sequenced from cells producing such antibodies using conventional procedures (e.g., by using oligonucleotide probes that are capable of binding specifically to genes encoding the heavy and light chains of the monoclonal antibodies).

An "isolated nucleic acid," which is used interchangeably herein with "isolated polynucleotide," is a nucleic acid that has been separated from adjacent genetic sequences present in the genome of the organism from which the nucleic acid was isolated, in the case of nucleic acids isolated from naturally-occurring sources. In the case of nucleic acids synthesized enzymatically from a template or chemically, such as PCR products, cDNA molecules, or oligonucleotides for example, it is understood that the nucleic acids resulting from such processes are isolated nucleic acids. An isolated nucleic acid molecule refers to a nucleic acid molecule in the form of a separate fragment or as a component of a larger nucleic acid construct.

In one preferred embodiment, the nucleic acids are substantially free from contaminating endogenous material. The nucleic acid molecule has preferably been derived from DNA or RNA isolated at least once in substantially pure form and in a quantity or concentration enabling identification, manipulation, and recovery of its component nucleotide sequences by standard biochemical methods (such as those outlined in Sambrook et al., Molecular Cloning: A Laboratory Manual, 2nd ed., Cold Spring Harbor Laboratory, Cold Spring Harbor, N.Y. (1989)). Such sequences are preferably provided and/or constructed in the form of an open reading frame uninterrupted by internal non-translated sequences, or introns, that are typically present in eukaryotic genes. Sequences of non-translated DNA can be present 5' or 3' from an open reading frame, where the same do not interfere with manipulation or expression of the coding region. Unless specified otherwise, the left-hand end of any single-stranded polynucleotide sequence discussed herein is the 5' end; the left-hand direction of double-stranded polynucleotide sequences is referred to as the 5' direction. The direction of 5' to 3' production of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The present invention also includes nucleic acids that hybridize under moderately stringent conditions, and more preferably highly stringent conditions, to nucleic acids encoding polypeptides as described herein. The basic parameters affecting the choice of hybridization conditions and guidance for devising suitable conditions are set forth by Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. One way of achieving moderately stringent conditions involves the use of a prewashing solution containing 5×SSC, 0.5% SDS, 1.0 mM EDTA (pH 8.0), hybridization buffer of about 50% formamide, 6×SSC, and a hybridization temperature of about 55° C. (or other similar hybridization solutions, such as one containing about 50% formamide, with a hybridization temperature of about 42° C.), and washing conditions of about 60° C., in 0.5×SSC, 0.1% SDS. Generally, highly stringent conditions are defined as hybridization conditions as above, but with washing at approximately 68° C., 0.2×SSC, 0.1% SDS. SSPE (1×SSPE is 0.15M NaCl, 10 mM $NaH_2PO_4$, and 1.25 mM EDTA, pH 7.4) can be substituted for SSC (1×SSC is 0.15M NaCl and 15 mM sodium citrate) in the hybridization and wash buffers; washes are performed for 15 minutes after hybridization is complete. It should be understood that the wash temperature and wash salt concentration can be adjusted as necessary to achieve a desired degree of stringency by applying the basic principles that govern hybridization reactions and duplex stability, as known to those skilled in the art and described further below (see, e.g., Sambrook et al., 1989). When hybridizing a nucleic acid to a target nucleic acid of unknown sequence, the hybrid length is assumed to be that of the hybridizing nucleic acid. When nucleic acids of known sequence are hybridized, the hybrid length can be determined by aligning the sequences of the nucleic acids and identifying the region or regions of optimal sequence complementarity. The hybridization temperature for hybrids anticipated to be less than 50 base pairs in length should be 5 to 10° C. less than the melting temperature (Tm) of the hybrid, where Tm is determined according to the following equations. For hybrids less than 18 base pairs in length, Tm (° C.)=2(# of A+T bases)+4(# of G+C bases). For hybrids above 18 base pairs in length, Tm (° C.)=81.5+16.6(log 10 [Na+])+0.41(% G+C)−(600/N), where N is the number of bases in the hybrid, and [Na+] is the concentration of sodium ions in the hybridization buffer ([Na+] for 1×SSC=0.165M). Preferably, each such hybridizing nucleic acid has a length that is at least 15 nucleotides (or more preferably at least 18 nucleotides, or at least 20 nucleotides, or at least 25 nucleotides, or at least 30 nucleotides, or at least 40 nucleotides, or most preferably at least 50 nucleotides), or at least 25% (more preferably at least 50%, or at least 60%, or at least 70%, and most preferably at least 80%) of the length of the nucleic acid of the present invention to which it hybridizes, and has at least 60% sequence identity (more preferably at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, and most preferably at least 99.5%) with the nucleic acid of the present invention to which it hybridizes, where sequence identity is determined by comparing the sequences of the hybridizing nucleic acids when aligned so as to maximize overlap and identity while minimizing sequence gaps as described in more detail above.

Variants of the antigen binding proteins described herein can be prepared by site-specific mutagenesis of nucleotides in the DNA encoding the polypeptide, using cassette or PCR mutagenesis or other techniques well known in the art, to produce DNA encoding the variant, and thereafter expressing the recombinant DNA in cell culture as outlined herein. However, antigen binding proteins comprising variant CDRs having up to about 100-150 residues may be prepared by in vitro synthesis using established techniques. The variants typically exhibit the same qualitative biological activity as the naturally occurring analogue, e.g., binding to antigen. Such variants include, for example, deletions and/or insertions and/or substitutions of residues within the amino acid sequences of the antigen binding proteins. Any combination of deletion, insertion, and substitution is made to arrive at the final construct, provided that the final construct possesses the desired characteristics. The amino acid changes also may alter post-translational processes of the antigen binding protein, such as changing the number or position of glycosylation sites. In certain embodiments, antigen binding protein variants are prepared with the intent to modify those amino acid residues which are directly involved in epitope binding. In other embodiments, modification of residues which are not directly involved in epitope binding or residues not involved in epitope binding in any way, is desirable, for purposes discussed herein. Mutagenesis within any of the CDR regions and/or framework regions is contemplated.

Covariance analysis techniques can be employed by the skilled artisan to design useful modifications in the amino acid sequence of the antigen binding protein. See, e.g., Choulier, et al., Proteins 41:475-484, 2000; Demarest et al., J. Mol. Biol. 335:41-48, 2004; Hugo et al., Protein Engineering 16(5):381-86, 2003; Aurora et al., US Patent Publication No. 2008/0318207 A1; Glaser et al., US Patent Publication No. 2009/0048122 A1; Urech et al., WO 2008/110348 A1; Borras et al., WO 2009/000099 A2. Such modifications determined by covariance analysis can improve potency, pharmacokinetic, pharmacodynamic, and/or manufacturability characteristics of an antigen binding protein.

Table 11 shows exemplary nucleic acid sequences encoding light and heavy chain variable regions of anti-PAC1 receptor antibodies, and Table 12 shows exemplary nucleic acid sequences encoding light and heavy chain variable regions of anti-CGRP receptor antibodies. Polynucleotides encoding the anti-PAC1 receptor and anti-CGRP receptor variable regions can be used to construct the anti-PAC1 receptor and anti-CGRP receptor binding domains, respectively, of the bispecific antigen binding proteins described herein.

TABLE 11

Exemplary Anti-PAC1 Receptor Variable Region Nucleic Acid Sequences

| Antibody ID | Designation | Nucleic Acid Sequence | SEQ ID NO: |
|---|---|---|---|
| Light chain variable regions | | | |
| 01A, 01C, 01D | LV-01 | GACATCCAGATGACCCAGTCTCCATCCTCCCTGTCTGCATCTGTAG GAGACAGAATCACCATCACTTGCCGGGCAAGTCAGAGCATTAGCA GGTATTTAAATTGGTATCAACAGAAACCAGGGAAAGCCCCTAAAC TCCTGATCTATGCTGCATCCAGTTTGCAAAGTGGGATCCCATCAAG GTTCAGCGGCAGTGGATCTGGGACAGATTTCACTCTCACCATCAAC AGTCTGCAACCTGAAGATTTTGCAACTTACTTCTGTCAACAGAGTT ACAGTCCCCCATTCACTTTCGGCCCTGGGACCAAAGTGGATATCAA ACGT | 464 |
| 01B | LV-02 | GACATCCAGATGACCCAGTCTCCATCCTCCCTGTCTGCATCTGTAG GAGACAGAATCACCATCACTTGCCGGGCAAGTCAGAGCATTAGCA GGTATTTAAATTGGTATCAACAGAAACCAGGGAAAGCCCCTAAAC TCCTGATCTATGCTGCATCCAGTTTGCAAAGTGGGATCCCATCAAG GTTCAGCGGCAGTGGATCTGGGACAGATTTCACTCTCACCATCAAC AGTCTGCAACCTGAAGATTTTGCAACTTACTTCTGTCAACAGAGTT ACAGTCCCCCATTCACTTTCGGCGAGGGGACCAAAGTGGATATCA AACGT | 465 |
| 02A, 02C | LV-03 | GACATCCAGATGACCCAGTCTCCATCCTCCCTGTCTGCATCTGTAG GAGACAGAATCACCATCACTTGCCGGGCAAGTCAGAGCATTAGCA GGTATTTAAATTGGTATCAACAGAAACCAGGGAAAGCCCCTAAAC TCCTGATCTATGCTGCATCCAGTTTGCAAAGTGGGATCCCATCAAG GTTCAGCGGCAGTGGATCTGGGACAGATTTCACTCTCACCATCAAC AGTCTGCAACCTGAAGATTTTGCAACTTACTTCTGTCAACAGAGTT ACAGTCCCCCATTCACTTTCGGCCAGGGGACCAAAGTGGATATCA AACGT | 466 |
| 03A, 03C, 03D | LV-04 | GATATCCAGCTCACTCAATCGCCATCATTTCTCTCCGCTTCGGTAG GCGACCGGGTCACGATCACATGCAGGGCGTCGCAAAGCATTGGGA GGTCGTTGCATTGGTATCAGCAGAAACCCGGAAAGGCCCCGAAAC TTCTGATCAAATACGCATCACAAAGCTTGAGCGGTGTGCCGTCGC GCTTCTCCGGTTCCGGAAGCGGAACGGAATTCACGCTTACAATCTC CTCACTGCAGCCCGAGGATTTCGCGACCTATTACTGTCACCAGTCA TCCAGACTCCCGTTTACTTTTGGCCCTGGGACCAAGGTGGACATTA AGCGT | 467 |
| 03B | LV-05 | GATATCCAGCTCACTCAATCGCCATCATTTCTCTCCGCTTCGGTAG GCGACCGGGTCACGATCACATGCAGGGCGTCGCAAAGCATTGGGA GGTCGTTGCATTGGTATCAGCAGAAACCCGGAAAGGCCCCGAAAC TTCTGATCAAATACGCATCACAAAGCTTGAGCGGTGTGCCGTCGC GCTTCTCCGGTTCCGGAAGCGGAACGGAATTCACGCTTACAATCTC CTCACTGCAGCCCGAGGATTTCGCGACCTATTACTGTCACCAGTCA TCCAGACTCCCGTTTACTTTTGGCGAGGGGACCAAGGTGGACATTA AGCGT | 468 |
| 04A, 04C, 04D | LV-06 | GAGATCGTACTTACTCAGTCACCCGCCACATTGTCCCTGAGCCCGG GTGAACGGGCGACCCTCAGCTGCCGAGCATCCCAGTCCGTCGGAC GATCATTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGACCAGGGACCAAGGTGGACATTA AGCGT | 469 |
| 04B | LV-07 | GAGATCGTACTTACTCAGTCACCCGCCACATTGTCCCTGAGCCCGG GTGAACGGGCGACCCTCAGCTGCCGAGCATCCCAGTCCGTCGGAC GATCATTGCACTGGTACCAACAAAAACCGGGCCAGGCCCCCAGAC TTCTGATCAAGTATGCGTCACAGAGCTTGTCGGGTATTCCCGCTCG CTTTTCGGGGTCGGGATCCGGGACAGATTTCACGCTCACAATCTCC TCGCTGGAACCCGAGGACTTCGCGGTCTACTATTGTCATCAGTCAT CGAGGTTGCCTTTCACGTTTGGAGAAGGGACCAAGGTGGACATTA AGCGT | 470 |
| 05A, 05C, 05D | LV-08 | GACATCGTGATGACCCAGTCTCCAGACTCCCTGGCTGTGTCTCTGG GCGAGAGGGCCACCATCCACTGCAAGTCCAGCCAGAGTGTTTTAT ACAGCTCCAACAATAAGAACTTCTTAACTTGGTACCAGCAGAAAC CAGGACAGCCTCCTAAACTTCTCATTTACCGGGCATCTACCCGGGA ATCCGGGGTTCCTGACCGATTCAGTGGCAGCGGGTCTGGGACAGA TTTCACTCTCACCATCAGCAGCCTGCAGGCTGAAGATGTGGCAGTT TATTTCTGTCAGCAATATTATAGTGCTCCATTCACTTTCGGCCCTGG GACCAGAGTGGATATCAAACGT | 471 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| 05B | LV-09 | GACATCGTGATGACCCAGTCTCCAGACTCCCTGGCTGTGTCTCTGG GCGAGAGGGCCACCATCCACTGCAAGTCCAGCCAGAGTGTTTTAT ACAGCTCCAACAATAAGAACTTCTTAACTTGGTACCAGCAGAAAC CAGGACAGCCTCCTAAACTTCTCATTTACCGGGCATCTACCCGGGA ATCCGGGGTTCCTGACCGATTCAGTGGCAGCGGGTCTGGGACAGA TTTCACTCTCACCATCAGCAGCCTGCAGGCTGAAGATGTGGCAGTT TATTTCTGTCAGCAATATTATAGTGCTCCATTCACTTTCGGCGAGG GGACCAGAGTGGATATCAAACGT | 472 |
| 06A, 06C | LV-10 | GACATCGTGATGACCCAGTCTCCAGACTCCCTGGCTGTGTCTCTGG GCGAGAGGGCCACCATCAACTGCAAGTCCAGCCAGAGTGTTTTAT ACAGCTCCAACAATAAGAACTTCTTAACTTGGTACCAGCAGAAAC CAGGACAGCCTCCTAAACTTCTCATTTACCGGGCATCTACCCGGGA ATCCGGGGTTCCTGACCGATTCAGTGGCAGCGGGTCTGGGACAGA TTTCACTCTCACCATCAGCAGCCTGCAGGCTGAAGATGTGGCAGTT TATTTCTGTCAGCAATATTATAGTGCTCCATTCACTTTCGGCCCTGG GACCAGAGTGGATATCAAACGT | 473 |
| 06B | LV-11 | GACATCGTGATGACCCAGTCTCCAGACTCCCTGGCTGTGTCTCTGG GCGAGAGGGCCACCATCAACTGCAAGTCCAGCCAGAGTGTTTTAT ACAGCTCCAACAATAAGAACTTCTTAACTTGGTACCAGCAGAAAC CAGGACAGCCTCCTAAACTTCTCATTTACCGGGCATCTACCCGGGA ATCCGGGGTTCCTGACCGATTCAGTGGCAGCGGGTCTGGGACAGA TTTCACTCTCACCATCAGCAGCCTGCAGGCTGAAGATGTGGCAGTT TATTTCTGTCAGCAATATTATAGTGCTCCATTCACTTTCGGCGAGG GGACCAGAGTGGATATCAAACGT | 474 |
| 07 | LV-12 | GAAATTGTGCTGACTCAGTCTCCAGACTTTCAGTCTGTGACTCCAA AGGAGAAAGTCACCATCACCTGCCGGGCCAGTCAGAGCATTGGTA GTAGCTTACACTGGTACCAGCAGAAACCAGATCAGTCTCCAAAGC TCCTCATCAAGTATGCTTCCCAGTCCTTGTCAGGGATCCCCTCGAG GTTTAGTGGCAGTGGATCTGGGACACATTTCACCCTCACCATCAAT AGCCTGGAAGCTGAAGATGCTGCAACGTATTACTGTCATCAGAGT AGTCGTTTACCATTCACTTTCGGCCCTGGGACCAAAGTGGATATCA AACGAAC | 475 |
| 08, 09, 10 | LV-13 | GAAATTGTGCTGACTCAGTCTCCAGACTTTCAGTCTGTGACTCCAA AGGAGAAAGTCACCATCACCTGCCGGGCCAGTCAGAGCGTTGGTC GTAGTTTACACTGGTACCATCAGAAACCAGATCAGTCTCCAAAGC TCCTCATCAAGTATGCTTCCCAGTCCTTATCAGGGGTCCCCTCGAG GTTCAGTGGCAGTGGATCTGGGACAGATTTCACCCTCATTATCAAT AGCCTGGAAGCTGAAGATGCTGCAACGTATTACTGTCATCAGAGT AGTCGTTTACCATTCACTTTCGGCCCTGGGACCAAAGTGGATATCA AACGAA | 476 |
| 11 | LV-14 | GATATCCAGCTCACTCAATCGCCATCATTTCTCTCCGCTTCGGTAG GCGACCGGGTCACGATCACATGCAGGGCGTCGCAAAGCATTGGGA GGTCGTTGCATTGGTATCACCAGAAACCCGGAAAGGCCCCGAAAC TTCTGATCAAATACGCATCACAAAGCTTGAGCGGTGTGCCGTCGC GCTTCTCCGGTTCCGGAAGCGGAACGGAATTCACGCTTATCATCTC CTCACTGCAGCCCGAGGATTTCGCGACCTATTACTGTCACCAGTCA TCCAGACTCCCGTTTACTTTTGGCCCTGGGACCAAGGTGGACATTA AGCGTAC | 477 |
| 12, 13, 14 | LV-15 | GAAATTGTGCTGACTCAGTCTCCAGACTTTCAGTCTGTGACTCCAA AGGAGAAAGTCACCATCACCTGCCGGGCCAGTCAGAGCGTTGGTC GTAGTTTACACTGGTACCAGCAGAAACCAGATCAGTCTCCAAAGC TCCTCATCAAGTATGCTTCCCAGTCCTTATCAGGGGTCCCCTCGAG GTTCAGTGGCAGTGGATCTGGGACAGATTTCACCCTCACTATCAAT AGCCTGGAAGCTGAAGATGCTGCAACGTATTACTGTCATCAGAGT AGTCGTTTACCATTCACTTTCGGCCCTGGGACCAAAGTGGATATCA AACGAAC | 478 |
| 15, 16, 17, 18 | LV-16 | GAGATCGTACTTACTCAGTCACCCGGCACATTGTCCCTGAGCCCGG GTGAACGGGCGACCCTCAGCTGCCGAGCATCCCAGTCCGTCGGAC GATCATTGCACTGGTACCAACAAAAACCGGGCCAGGCCCCCAGAC TTCTGATCAAGTATGCGTCACAGAGCTTGTCGGGTATTCCCGATCG CTTTTCGGGGTCGGGATCCGGGACAGATTTCACGCTCACAATCTCC CGACTGGAACCCGAGGACTTCGCGACCTACTATTGTCATCAGTCAT CGAGGTTGCCTTTCACGTTTGGACAGGGGACCAAGGTGGAGATTA AGCGTA | 479 |
| 19 | LV-17 | GAAATTGTGCTGACTCAGTCTCCAGACTTTCAGTCTGTGACTCCAA AGGAGAAAGTCACCATCACCTGCCGGGCCAGTCAGAGCATTGGTC | 480 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| | | GTAGTTTACACTGGTACCAGCAGAAACCAGATCAGTCTCCAAAGC TCCTCTTCAAGTATGCTTCCCAGTCCTTATCAGGGGTCCCCTCGAG GTTCAGTGGCAGTGGATCTGGGACAGATTTCACCCTCACAATCAAT AGCCTGGAAGCTGAAGATGCTGCAACGTATTACTGTCATCAGAGT AGTCGTTTACCATTCACTTTCGGCCCTGGGACCAAAGTGGATATCA AACGAA | |
| 20 | LV-18 | GATATCCAGCTCACTCAATCGCCATCATTTCTCTCCGCTTCGGTAG GCGACCGGGTCACGATCACATGCAGGGCGTCGCAAAGCATTGGGA GGTCGTTGCATTGGTATCAGCAGAAACCCGGAAAGGCCCCGAAAC TTCTGTTCAAATACGCATCACAAAGCTTGAGCGGTGTGCCGTCGCG CTTCTCCGGTTCCGGAAGCGGAACGGAATTCACGCTTACAATCTCC TCACTGCAGCCCGAGGATTTCGCGACCTATTACTGTCACCAGTCAT CCAGACTCCCGTTTACTTTTGGCCCTGGGACCAAGGTGGACATTAA GCGTAC | 481 |
| 21 | LV-19 | GAAATTGTGTTGACGCAGTCGCCAGGCACCCTGTCTTTGTCTCCAG GGGAAAGAGCCACCCTCTCCTGCAGGGCCAGTCAGAGTGTTAGCA GCAGCTACTTAGCCTGGTACCAGCAGAAACCTGGCCAGGCTCCCA GGCTCCTCATCTATGGTGCATCCAGCAGGGCCACTGGCATCCCAG ACAGGTTCAGTAACAGTGGGTCTGGGACAGACTTCACTCTCACCA TCAGCAGACTGGAGCCTGAAGATTTTGCAGTGTATTACTGTCAGA GGTATGGTAGCTCACGGACGTTCGGCCAAGGGACCAAGGTGGAAA TCAAACGAA | 482 |
| 22 | LV-20 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTATTTGGATTGGTACCTGCAGAAGCCAGG GCAGTCTCCACAGCTCCTGCTCTATTTGGGTTCTAATCGGGCCTCC GGGGTCCCTGACAGGTTCAGTGGCAGTGGATCAGGCACAGATTTT ACACTGCAAATCAGCAGAGTGGAGGCTGAGGATGTTGGGGTTTAT TACTGCATGCAAACTCTACAAACTCCATTCACTTTCGGCCCTGGGA CCAAAGTGGATATCAAACGT | 483 |
| 23 | LV-21 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTATTTGGATTGGTACCTGCAGAAGCCAGG GCAGTCTCCACAGCTCCTGCTCTATTTGGGTTCTAATCGGGCCTCC GGGGTCCCTGACAGGTTCAGTGGCAGTGGATCAGGCACAGATTTT ACACTGAAAATCAGCAGAGTGGAGGCTGAGGATGTTGGGGTTTAT TACTGCATGCAAACTCTACAAACTCCATTCACTTTCGGCCCTGGGA CCAAAGTGGATATCAAACGT | 484 |
| 24 | LV-22 | GAAATTGTGTTGACGCAGTCTCCAGGCACCCTGTCTTTGTCTCCAG GGGAAAGAGCCACCCTCTCCTGCAGGGCCAGTCAGACTGTTAGCA GGAGCTACTTAGCCTGGTACCAGCAGAAACCTGGCCAGGCTCCCA GGCTCCTCATCTATGGTGCATCCAGCAGGGCCACTGGCATCCCAG ACAGGTTCAGTGGCAGTGGGTCTGGGACAGACTTCACTCTCACCA TCAGCAGACTGGAGCCTGAAGATTTTGCCGTGTTTTACTGTCAGCA GTTTGGTAGCTCACCGTGGACGTTCGGCCAAGGGACCAAGGTGGA AATCAAACGT | 485 |
| 25 | LV-23 | GACATCGTGATGACCCAGTCTCCAGACTCCCTGGCTGTGTCTCTGG GCGAGAGGGCCACCATCCATTGCAAGTCCAGCCAGAATGTTTTAT ACAGCTCCAACAATAAGAACTTCTTAACTTGGTACCAGCAGAAAC CAGGACAGCCCCCTAAACTGCTCATTTACCGGGCATCTACCCGGG AATCCGGGGTCCCTGACCGATTCAGTGGCAGCGGGTCTGGGACGG ATTTCACTCTCACTATCAGCAGTCTGCAGGCTGAAGATGTGGCAGT TTATTTCTGTCAGCAATATTATAGTGCTCCATTCACTTTCGGCCCTG GGACCAAAGTGGATATCAAACGTAC | 486 |
| 26 | LV-24 | GACATCGTGATGACCCAGTCTCCAGACTCCCTGGCTGTGTCTCTGG GCGAGAGGACCACCATCAAGTGCAAGTCCAGCCAGAGTGTTTTAT ACAGATCCAACAATAACAACTTCTTAGCTTGGTACCAGCAGAAAC CAGGACAGCCTCCTAAGCTGCTCATTTATTGGGCATCTACCCGGGA ATCCGGGGTCCCTGACCGATTCAGTGGCAGCGGGTCTGGGACAGA TTTCACTCTCACCATCAGCAGCCTGCAGGCTGAAGATGTGGCTGTT TATTTCTGTCAGCAATATTATATTTCTCCGCTCACTTTCGGCGGAG GGACCAAGGTGGAGATCAAACGTA | 487 |
| 27 | LV-25 | GACATCGTGATGACCCAGTCTCCAGACTCCCTGGCTGTGTCTCTGG GCGAGAGGGCCACCATCAACTGCAAGTCCAGCCAGAGTGTTTTAT ACAGTTCCAACAATAAGCACTACTTAGCTTGGTACCGGCAGAAAC CAGGACAGCCTCCTAAACTGCTCATTTACAGGGCATCTACCCGGG | 488 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| | | AATCCGGGGTCCCTGACCGATTCAGTGGCAGCGGGTCTGGGACAG ATTTCACTCTCACCATCAGCAGCCTGCAGCCTGAAGATGTGGCAGT GTATTACTGTCAGCAATATTATAGTTCTCCATTCACTTTCGGCCCTG GGACCAAAGTGGATATCAAACGTA | |
| 28 | LV-26 | GACATCGTGATGACTCAGTCTCCAGACTCCCTGGCTGTGTCTCTGG GCGAGAGGGCCACCATCCACTGCAAGTCCAGCCAGAGTGTTTTAT ACAGCTCCAACAATAGGAACTTCTTAAGTTGGTACCAGCAGAAAC CAGGACAGCCTCCTAAACTGCTCATTTACCGGGCATCTACCCGGG AATCCGGGTCCCTGACCGATTCAGTGGCAGCGGGTCTGGGACAG ATTTCACTCTCACCATCAGCAGCCTGCAGGCTGAAGATGTGGCAGT TTATTTCTGTCAGCAATATTATAGTGCTCCATTCACTTTCGGCCCTG GGACCACAGTGGATATCAAACGTAC | 489 |
| 29 | LV-27 | GACATCGTGATGACCCAGTCTCCAGACTCCCTGGCTGTGTCTCTGG GCGAGAGGGCCACCATCAACTGCAAGTCCAGCCAGAGTGTTTTAT ACAGTTCCAACAATAAGAACTACTTAGCTTGGTACCGGCAGAAAC CAGGACAGCCTCCTAAGCTGCTCATTTACAGGGCATCTACCCGGG AATCCGGGTCCCTGACCGATTCAGTGGCAGCGGGTCTGGGACAG ATTTCACTCTCACCATCAGCAGCCTGCAGGCTGAAGATGTGGCAGT GTATCACTGTCAGCAATATTATAGTTCTCCATTCACTTTCGGCCCT GGGACCAAAGTGGATATCAAACGTAC | 490 |

Heavy chain variable regions

| Antibody ID | Designation | Nucleic Acid Sequence | SEQ ID NO: |
|---|---|---|---|
| 01A, 01C, 01D, 02A, 02C | HV-01 | CAGGTACAGCTGCAGCAGTCAGGTCCAGGACTGGTGAAGCCCTCG CAGACCCTCTCACTCACCTGTGCCATCTCCGGGGACAGTGTCTCTA GCAACAGTGCTACTTGGAACTGGATCAGGCAGTCCCCATCGAGAG GCCTTGAGTGGCTGGGAAGGACATATTACAGGTCCAAGTGGTCTA ATCATTATGCAGTATCTGTGAAAAGTCGAATAACCATCAACCCCG ACACGTCCAAGAGCCAGTTCTCCCTGCAGCTGAACTCTGTGACTCC CGAGGACACGGCTGTGTATTACTGTGCAAGAGGAACGTGGAAACA GCTATGGTTCCTTGACCACTGGGGCCAGGGAACCCTGGTCACCGTC TCTAGT | 491 |
| 01B | HV-02 | CAGGTACAGCTGCAGCAGTCAGGTCCAGGACTGGTGAAGCCCTCG CAGACCCTCTCACTCACCTGTGCCATCTCCGGGGACAGTGTCTCTA GCAACAGTGCTACTTGGAACTGGATCAGGCAGTCCCCATCGAGAA AGCTTGAGTGGCTGGGAAGGACATATTACAGGTCCAAGTGGTCTA ATCATTATGCAGTATCTGTGAAAAGTCGAATAACCATCAACCCCG ACACGTCCAAGAGCCAGTTCTCCCTGCAGCTGAACTCTGTGACTCC CGAGGACACGGCTGTGTATTACTGTGCAAGAGGAACGTGGAAACA GCTATGGTTCCTTGACCACTGGGGCCAGGGAACCCTGGTCACCGTC TCTAGT | 492 |
| 03A, 03C, 03D, 09, 13, 15 | HV-03 | CAAGTTCAGTTGGTGGAGTCTGGAGCCGAAGTAGTAAAGCCAGGA GCTTCAGTGAAAGTCTCTTGTAAAGCAAGTGGATTCACGTTTAGCC GCTTTGCCATGCATTGGGTGCGGCAAGCTCCCGGTCAGGGGTTGG AGTGGATGGGAGTTATTAGCTATGACGGGGGCAATAAGTACTACG CCGAGTCTGTTAAGGGTCGGGTCACAATGACACGGGACACCTCAA CCAGTACACTCTATATGGAACTGTCTAGCCTGAGATCCGAGGACA CCGCTGTGTATTATTGCGCTAGGGGGTACGATGTATTGACGGGTTA TCCTGATTACTGGGGGCAGGGGACACTCGTAACCGTCTCTAGT | 493 |
| 03B | HV-04 | CAAGTTCAGTTGGTGGAGTCTGGAGCCGAAGTAGTAAAGCCAGGA GCTTCAGTGAAAGTCTCTTGTAAAGCAAGTGGATTCACGTTTAGCC GCTTTGCCATGCATTGGGTGCGGCAAGCTCCCGGTCAGAAGTTGG AGTGGATGGGAGTTATTAGCTATGACGGGGGCAATAAGTACTACG CCGAGTCTGTTAAGGGTCGGGTCACAATGACACGGGACACCTCAA CCAGTACACTCTATATGGAACTGTCTAGCCTGAGATCCGAGGACA CCGCTGTGTATTATTGCGCTAGGGGGTACGATGTATTGACGGGTTA TCCTGATTACTGGGGGCAGGGGACACTCGTAACCGTCTCTAGT | 494 |
| 04A, 04C, 04D | HV-05 | CAGGTGCAGCTGGTGGAGTCTGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATGATGGAGGAAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCTAGT | 495 |
| 04B | HV-06 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA | 496 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| | | GATTTGCCATGCACTGGGTCCGCCAGGCTCCAGGCAAGAAGCTGG AGTGGGTGGCAGTTATATCATATGATGGAGGAAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCTAGT | |
| 05A, 05C, 05D | HV-07 | CAGGTGCAGCTGCAGGAGTCGGGCCCAGGACTGGTGAAGCCTTCA CAGACCCTGTCCCTCACCTGCACTGTCTCTGGTGGCTCCATCAGCA GTGGTGGTTACTACTGGAGCTGGATCCGCCAGCACCCAGGGAAGG GCCTGGAGTGGATTGGGTACATCTATTACAGTGGGAACACCTACT ACAACCCGTCCCTCAAGAGTCGAGTTACCATATCAGGAGACACGT CTAAGAACCAGTTCTCCCTGAAGCTGAGGTCTGTGACTGCCGCGG ACACGGCCGTGTATTACTGTACGAGAGGAGGAGCAGCTCGCGGTA TGGACGTCTGGGGCCAAGGGACCACGGTCACCGTCTCTAGT | 497 |
| 05B | HV-08 | CAGGTGCAGCTGCAGGAGTCGGGCCCAGGACTGGTGAAGCCTTCA CAGACCCTGTCCCTCACCTGCACTGTCTCTGGTGGCTCCATCAGCA GTGGTGGTTACTACTGGAGCTGGATCCGCCAGCACCCAGGGAAGA AGCTGGAGTGGATTGGGTACATCTATTACAGTGGGAACACCTACT ACAACCCGTCCCTCAAGAGTCGAGTTACCATATCAGGAGACACGT CTAAGAACCAGTTCTCCCTGAAGCTGAGGTCTGTGACTGCCGCGG ACACGGCCGTGTATTACTGTACGAGAGGAGGAGCAGCTCGCGGTA TGGACGTCTGGGGCCAAGGGACCACGGTCACCGTCTCTAGT | 498 |
| 06A, 06C | HV-09 | CAGGTGCAGCTGCAGGAGTCGGGCCCAGGACTGGTGAAGCCTTCA GAGACCCTGTCCCTCACCTGCACTGTCTCTGGTGGCTCCATCAGCA GTGGTGGTTACTACTGGAGCTGGATCCGCCAGCCCCAGGGAAGG GCCTGGAGTGGATTGGGTACATCTATTACAGTGGGAACACCTACT ACAACCCGTCCCTCAAGAGTCGAGTTACCATATCAGTGGACACGT CTAAGAACCAGTTCTCCCTGAAGCTGAGGTCTGTGACTGCCGCGG ACACGGCCGTGTATTACTGTACGAGAGGAGGAGCAGCTCGCGGTA TGGACGTCTGGGGCCAAGGGACCACGGTCACCGTCTCTAGT | 499 |
| 06B | HV-10 | CAGGTGCAGCTGCAGGAGTCGGGCCCAGGACTGGTGAAGCCTTCA GAGACCCTGTCCCTCACCTGCACTGTCTCTGGTGGCTCCATCAGCA GTGGTGGTTACTACTGGAGCTGGATCCGCCAGCCCCAGGGAAGA AGCTGGAGTGGATTGGGTACATCTATTACAGTGGGAACACCTACT ACAACCCGTCCCTCAAGAGTCGAGTTACCATATCAGTAGACACGT CTAAGAACCAGTTCTCCCTGAAGCTGAGGTCTGTGACTGCCGCGG ACACGGCCGTGTATTACTGTACGAGAGGAGGAGCAGCTCGCGGTA TGGACGTCTGGGGCCAAGGGACCACGGTCACCGTCTCTAGT | 500 |
| 07 | HV-11 | CAGGTGCAGTTGGTGGAGTCTGGGGGAGGCGTGGTCCAGCCTGGG AGGTCCCTGAGACTCTCCTGTGCAGCCTCTGGATTCACCTTCAGTT ACTATGCCATACACTGGGTCCGCCAGGCTCCAGGCAAGGGGCTAG AGTGGGTGGCAGTTATCTCATATGATGGAAGTAATAAATACTATG CAGACTCCGTGAAGGGCCGATTCACCATCTCCAGAGACAATTCCA AGAACACGCTGTATCTGCAAATGAACAGCCTGAGAGCTGAGGACA CGGCTGTGTATTACTGTGCGAGAGGATACGATCTTTTGACTGGTTA CCCCGACTACTGGGGCCAGGGAACCCTGGTCACCGTCTCCTCAG | 501 |
| 11, 14 | HV-12 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCGGGCTCCAGGCAAGGGGCTGG AGTGGGTGGCAGTTATATCATATGATGGAGGAAATAAATACTATG CAGAGTCCGTGAAGGGCCGGTTCACCATCTCCAGAGACAATTCCA AGAACACCCTGAATCTGCTAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCCTCAGC | 502 |
| 08, 12 | HV-13 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATGATGGAGGAAATAAATACTATG CAGAGTCCGTGAAGGGCCGGTTCACCATCTCCAGAGACAATTCCA AGAACACCCTGAATCTGCTAATGAACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCCTCAGC | 503 |
| 10 | HV-14 | CAGGTGCAGCTGGTGGAGTCTGGGGGAGGCGTGGTCCAGCCTGGG AGGTCCCTGCGACTCTCCTGTGCAGCCTCTGGATTCACCTTCAGTA GATTTGCCATGCACTGGGTCCGCCGGGCTCCAGGCAAGGGGCTGG AGTGGGTGGCAGTTATATCATATGATGGAGGAAATAAATACTATG | 504 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| | | CAGAGTCCGTGAAGGGCCGGTTCACCATCTCCAGAGACAATTCCA AGAACACCCTGAATCTGCTAATGGACAGCCTGAGAGCTGAGGACA CGGCTCTGTTTTACTGTGCGAGAGGATACGATGTTTTGACTGGTTA CCCCGACTACTGGGGCCAGGGAACCCTGGTCACCGTCTCCTCA | |
| 16 | HV-15 | CAAGTTCAGTTGGTGCAATCTGGAGCCGAAGTAAAGAAGCCAGGA GCTTCAGTGAAAGTCTCTTGTAAAGCAAGTGGATTCACGTTTAGCC GCTTTGCCATGCATTGGGTGCGGCAAGCTCCCGGTCAGGGGTTGG AGTGGATGGGAGTTATTAGCTATGACGGGGGCAATAAGTACTACG CCGAGTCTGTTAAGGGTCGGGTCACAATGACACGGGACACCTCAA CCAGTACAGCCTATATGGAACTGTCTAGCCTGAGATCCGAGGACA CCGCTGTGTATTATTGCGCTAGGGGGTACGATGTATTGACGGGTTA TCCTGATTACTGGGGGCAGGGGACACTCGTAACCGTCTCTAGT | 505 |
| 17 | HV-16 | CAAGTTCAGTTGGTGCAATCTGGAGCCGAAGTAAAGAAGCCAGGA GCTTCAGTGAAAGTCTCTTGTGCCGCAAGTGGATTCACGTTTAGCC GCTTTGCCATGCATTGGGTGCGGCAAGCTCCCGGTCAGGGGTTGG AGTGGATGGGAGTTATTAGCTATGACGGGGGCAATAAGTACTACG CCGAGTCTGTTAAGGGTCGGGTCACAATGACACGGGACAACTCAA AAAATACAGCCTATATGGAACTGTCTAGCCTGAGATCCGAGGACA CCGCTGTGTATTATTGCGCTAGGGGGTACGATGTATTGACGGGTTA TCCTGATTACTGGGGGCAGGGGACACTCGTAACCGTCTCTAGT | 506 |
| 18 | HV-17 | GAGGTGCAGCTGCTGGAGTCTGGGGGAGGCCTGGTCCAGCCTGGG GGGTCCCTGCGACTCTCCTGTGCAGCCTCTGGATTCACCTTCAGTA GATTTGCCATGCACTGGGTCCGCCAGGCTCCAGGCAAGGGGCTGG AGTGGGTGGCAGTTATATCATATGATGGAGGAAATAAATACTATG CAGAGTCCGTGAAGGGCCGGTTCACCATCTCCAGAGACAATTCCA AGAACACCCTGTATCTGCAAATGAACAGCCTGAGAGCTGAGGACA CGGCTGTGTATTACTGTGCGAGAGGATACGATGTTTTGACTGGTTA CCCCGACTACTGGGGCCAGGGAACCCTGGTCACCGTCTCCTCAGC | 507 |
| 19, 20 | HV-18 | CAGGTGCAGCTGGTGGAGTCTGGGGGAGGCGTGGTCCAGCCTGGG AGGTCCCTGCGACTCTCCTGTGCAGCCTCTGGATTCACCTTCAGTC GCTATGCCATGCACTGGGTCCGCCAGGCTTCAGGCAAGGGGCTGG AGTGGGTGGCAGTTATATCATATGATGGAAGTAATAAATACTATG CAGACTCCGTGAAGGGCCGATTCACCATCTCCAGAGACAATTCCA AGAACACCCTGTATCTGCTAATGAGCAGCCTGAGAGCTGAGGACA CGGCTGTGTTTTACTGTGCGAGAGGATACGATATTTTGACTGGTTA CCCCGACTACTGGGGCCAGGGAACCCTGGTCACCGTCTCCTCA | 508 |
| 21 | HV-19 | CAGGTTCAGCTGGTGCAGTCTGGAGCTGAGGTGAAGAAGCCTGGG GCCTCAGTGAAGGTCTCCTGCAAGGGCTTCTGGTTACACCTTTACCA GCTATGGTATCAGCTGGGTGCGACAGGCCCCTGGACAAGGGCTTG AGTGGATGGGATGGATCAACGCTTACAATGGTCACACAAACTATG CACAGACGTTCCAGGGCAGAGTCACCATGACCACAGACACATCCA CGAGCACAGCCTACATGGAGCTGAGGAGCCTGAGATCTGACGACA CGGCCGTGTATTACTGTGCGAGGGAACTGGAACTACGCTCCTTCTA TTACTTCGGTATGGACGTCTGGGGCCAAGGGACCACGGTCCCCGT CTCTAGTG | 509 |
| 22 | HV-20 | CAGGTTCAGCTGGTGCAGTCTGGAGCTGAGGTGAAGAAGTCTGGG GCCTCTTTGAAGGTCTCCTGCAAGGGCTTCTGGTTACATTTTTACCC GCTATGGTGTCAGCTGGGTGCGACAGGCCCCTGGACAAGGGCTTG AGTGGATGGGATGGATCACCACTTACAATGGTAACACAAACTATG CACAGAAGCTCCAGGGCAGAGTCACCATGACCATAGACACATCCA CGAGCACAGCCTACATGGAACTGAGAAGCCTCAGATCTGACGACA CGGCCGTGTATTACTGTGCGAGAAGAGTGCGGTATAGTGGGGGCT ACTCGTTTGACAACTGGGGCCAGGGAACCCTGGTCACCGTCTCTA GT | 510 |
| 23 | HV-21 | CAGGTTCAGCTGGTGCAGTCTGGAGCTGAGGTGAAGAAGTCTGGG GCCTCTTTGAAGGTCTCCTGCAAGGGCTTCTGGTTACATTTTTACCC GCTATGGTGTCAGCTGGGTGCGACAGGCCCCTGGACAAGGGCTTG AGTGGATGGGATGGATCACCACTTACAATGGTAATACAAACTATG CACAGAAGCTCCAGGGCAGAGTCACCATGACCACAGACACATCCA CGAGCACAGCCTACATGGAACTGAGGAGCCTCAGATCTGACGACA CGGCCGTGTATTACTGTGCGAGAAGAGTGCGGTACAGTGGGGGCT ACTCGTTTGACAACTGGGGCCAGGGAACCCTGGTCACCGTCTCTA GTGC | 511 |
| 24 | HV-22 | CAGGTGCAGCTGCAGGAGTCGGGCCCAGGACTGGTGAAGCCTTCG GAGACCCTGTCCCTCACCTGCACTGTCTCTGGTGGCTCCATCAGTA GTTACTACTGGAGCTGGATCCGGCAGCCCGCCGGGAAGGGACTGG | 512 |

TABLE 11-continued

Exemplary Anti-PAC1 Receptor Variable Region Nucleic Acid Sequences

| Antibody ID | Designation | Nucleic Acid Sequence | SEQ ID NO: |
|---|---|---|---|
| | | AATGGATTGGGCGTATCTATACCAGTGGGAGCACCAACTACAACC CCTCCCTCAAGAGTCGAGTCACCATGTCAATAGGCACGTCCAAGA ACCAGTTCTCCCTGAAGCTGAGCTCTGTGACCGCCGCGGACACGG CCGTGTATTACTGTGCGATTATTGCATCTCGTGGCTGGTACTTCGA TCTCTGGGGCCGTGGCACCCTGGTCACCGTCTCTAGTG | |
| 25, 28 | HV-23 | CAGGTGCAGCTGCAGGAGTCGGGCCCAGGACTGGTGAAGCCTTCA CAGACCCTGTCCCTCACCTGCACTGTCTCTGGTGGCTCCATCAGCA GTGGTGGTTACTACTGGAGCTGGATCCGCCAGCACCCAGGGAAGG GCCTGGAGTGGATTGGGTACATCTATTACAGTGGGAACACCTACT ACAACCCGTCCCTCAAGAGTCGAGTTACCATATCAGGAGACACGT CTAAGAACCAGTTCTCCCTGAAGCTGAGGTCTGTGACTGCCGCGG ACACGGCCGTGTATTACTGTGCGAGAGGAGGAGCAGCTCGCGGTA TGGACGTCTGGGGCCAAGGGACCACGGTCACCGTCTCTAGTGC | 513 |
| 26 | HV-24 | CAGGTACAGCTGCAGCAGTCAGGTCCAGGACTGGTGAAGCCCTCG CAGACCCTCTCACTCACCTGTGCCATCTCCGGGGACAGTGTCTCTA GCAACAGTGCTGCTTGGAACTGGATCAGGCAGTCCCCATCGAGAG GCCTTGAGTGGCTGGGAAGGACATACTACAGGTCCAGGTGGTATA ATGATTATGCAGTATCTGTGAAAAGTCGAATAACCATCAACCCAG ACACATCCAAGAACCAGTTCTCCCTGCAGCTGAACTCTGTGACTCC CGAGGACACGGCTGTGTATTACTGTGCAAGAGGGGTCTTTTATAG CAAAGGTGCTTTTGATATCTGGGGCCAAGGGACAATGGTCACCGT CTCTAGTG | 514 |
| 27 | HV-25 | CAGGTGCAGCTGCAGGAGTCGGGCCCAGGACTGGTGAAGCCTTCA CAGACCCTGTCCCTCACCTGCACTGTCTCTGGTGGCTCCATCAGCC GTGGTGGTTACTACTGGAGCTGGATCCGCCAGCACCCAGGGAAGG GCCTGGAGTGGATTGGGTACATATATTACAGTGGGAATACCTACT ACAACCCGTCCCTCAAGAGTCGAGTTATCATATCAGGAGACACGT CTAAGAACCAGCTCTCCCTGAAGCTGAGGTCTGTGACTGCCGCGG ACACGGCCGTGTATTATTGTGCGAGAGGAGGAGCAGCTCGCGGTA TGGACGTCTGGGGCCAAGGGACCACGGTCACCGTCTCTAGTGC | 515 |
| 29 | HV-26 | CAGGTGCAGCTGCAGGAGTCGGGCCCAGGACTGGTGAAGCCTTCA CAGACCCTGTCCCTCACCTGCACTGTCTCTGGTGGCTCCATCAGCA GTGGTGGTTTCTACTGGAGCTGGATCCGCCAGCACCCAGGGAAGG GCCTGGAGTGGATTGGGTACATCTATTACAGTGGGAATACCTACT ACAACCCGTCCCTCAAGAGTCGAGTTATCATATCAGGAGACACGT CTAAGAACCAGTTCTCCCTGAAGCTGAGCTCTGTGACGGCCGCGG ACACGGCCGTGTATTACTGTGCGAGAGGAGGAGCAGCTCGCGGTA TGGACGTCTGGGGCCAAGGGACCACGGTCACCGTCTCTAGTGC | 516 |

TABLE 12

Exemplary Anti-CGRP Receptor Variable Region Nucleic Acid Sequences

| Antibody ID | Designation | Nucleic Acid Sequence | SEQ ID NO: |
|---|---|---|---|
| Light chain variable regions | | | |
| 50A, 50C, 50D, 70 | LV-101 | CAGTCTGTGCTGACTCAGCCACCCTCAGCGTCTGGGACCCCCGGGC AGAGAGTCACCATCTCTTGTTCTGGAAGCAGCTCCAACATCGGCA GTAATTATGTATACTGGTACCAGCAGCTCCCAGGAGCGGCCCCCA AACTCCTCATCTTTAGGAATAATCAGCGGCCCTCAGGGGTCCCTGA CCGCTTCTCTGGCTCCAAGTCTGGCACCTCAGCCTCCCTGGCCATC AGTGGGCTCCGGTCCGAGGATGAGGCTGATTATTACTGTGCAGCA TGGGATGACAGCCTGAGTGGTTGGGTGTTCGGCGGAGGGACCAAG CTGACCGTCCTAGGT | 517 |
| 50B | LV-102 | CAGTCTGTGCTGACTCAGCCACCCTCAGCGTCTGGGACCCCCGGGC AGAGAGTCACCATCTCTTGTTCTGGAAGCAGCTCCAACATCGGCA GTAATTATGTATACTGGTACCAGCAGCTCCCAGGAGCGGCCCCCA AACTCCTCATCTTTAGGAATAATCAGCGGCCCTCAGGGGTCCCTGA CCGCTTCTCTGGCTCCAAGTCTGGCACCTCAGCCTCCCTGGCCATC AGTGGGCTCCGGTCCGAGGATGAGGCTGATTATTACTGTGCAGCA TGGGATGACAGCCTGAGTGGTTGGGTGTTCGGCAAGGGGACCAAG CTGACCGTCCTAGGT | 518 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| 51A, 51C, 51D | LV-103 | CAGTCTGTGCTGACTCAGTCACCCTCAGCGTCTGGGACCCCCGGGC AGAGAGTCACCATCTCTTGTTCTGGAAGCAGCTCCAACATCGGCA GTAATTATGTATACTGGTACCAGCAGCTCCCAGGAGCGGCCCCCA AACTCCTCATCCTTAGGAATAATCAGCGGCCCTCAGGGGTCCCTGA CCGATTCTCTGGCTCCAAGTCTGGCACCTCAGCCTCCCTGACCATC AGTGGGCTCCGGTCCGAGGATGAGGCTGACTATTATTGTGCAGCA TGGGATGACAGCCTGAGTGGTTGGGTGTTCGGCGGAGGGACCAAG CTGACCGTCCTAGGT | 519 |
| 51B | LV-104 | CAGTCTGTGCTGACTCAGTCACCCTCAGCGTCTGGGACCCCCGGGC AGAGAGTCACCATCTCTTGTTCTGGAAGCAGCTCCAACATCGCA GTAATTATGTATACTGGTACCAGCAGCTCCCAGGAGCGGCCCCCA AACTCCTCATCCTTAGGAATAATCAGCGGCCCTCAGGGGTCCCTGA CCGATTCTCTGGCTCCAAGTCTGGCACCTCAGCCTCCCTGACCATC AGTGGGCTCCGGTCCGAGGATGAGGCTGACTATTATTGTGCAGCA TGGGATGACAGCCTGAGTGGTTGGGTGTTCGGCAAGGGGACCAAG CTGACCGTCCTAGGT | 520 |
| 52A, 52C, 52D, 53A, 53C | LV-105 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAACCACCCTGGGCATC ACCGGACTCCAGACTGGGGACGAGGCCGATTATTACTGCGGAACA TGGGATAGCCGCCTGAGTGCTGTGGTTTTCGGCGGAGGGACCAAG CTGACCGTCCTAGGT | 521 |
| 52B, 53B | LV-106 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAACCACCCTGGGCATC ACCGGACTCCAGACTGGGGACGAGGCCGATTATTACTGCGGAACA TGGGATAGCCGCCTGAGTGCTGTGGTTTTCGGCAAGGGGACCAAG CTGACCGTCCTAGGT | 522 |
| 54A, 54C, 56A, 56C, 71 | LV-107 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGGAACA TGGGATAGCCGCCTGAGTGCTGTGGTTTTCGGCGGAGGGACCAAG CTGACCGTCCTAGGT | 523 |
| 54B, 56B | LV-108 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGGAACA TGGGATAGCCGCCTGAGTGCTGTGGTTTTCGGCAAGGGGACCAAG CTGACCGTCCTAGGT | 524 |
| 55A, 55C | LV-109 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGCCATC ACCGGACTCCAGACTGGGGACGAGGCCGATTATTACTGCGGAACA TGGGATAGCCGCCTGAGTGCTGTGGTTTTCGGCGGAGGGACCAAG CTGACCGTCCTAGGT | 525 |
| 55B | LV-110 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGCTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGCCATC ACCGGACTCCAGACTGGGGACGAGGCCGATTATTACTGCGGAACA TGGGATAGCCGCCTGAGTGCTGTGGTTTTCGGCAAGGGGACCAAG CTGACCGTCCTAGGT | 526 |
| 57A, 57C, 57D, 58A, | LV-111 | GAAATTGTGTTGACGCAGTCTCCAGGCACCCTGTCTTTGTCTCCAG GGGAAAGAGCCACCCTCTCCTGCAGGGCCAGTCAGAGTGTTAGCA | 527 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| 58C | | GCGGCTACTTAACCTGGTACCAGCAGAAACCTGGCCAGGCTCCCA GACTCCTCATCTATGGTGCATCCAGCAGGGCCACTGGCATCCCAG ACAGGTTCAGTGGCAGTGGGTCTGGGACGGACTTCACTCTCACCA TCAGCAGACTGGAGCCTGAAGATTTTGCAGTGTATTACTGTCAGCA GTATGGTAACTCACTGAGCAGGTTTGGCCAGGGGACCAAGCTGGA AATCAAACGT | |
| 57B, 58B | LV-112 | GAAATTGTGTTGACGCAGTCTCCAGGCACCCTGTCTTTGTCTCCAG GGGAAAGAGCCACCCTCTCCTGCAGGGCCAGTCAGAGTGTTAGCA GCGGCTACTTAACCTGGTACCAGCAGAAACCTGGCCAGGCTCCCA GACTCCTCATCTATGGTGCATCCAGCAGGGCCACTGGCATCCCAG ACAGGTTCAGTGGCAGTGGGTCTGGGTACGGACTTCACTCTCACCAT CAGCAGACTGGAGCCTGAAGATTTTGCAGTGTATTACTGTCAGCA GTATGGTAACTCACTGAGCAGGTTTGGCAAGGGGACCAAGCTGGA GATCAAACGT | 528 |
| 59 | LV-113 | CAGTCTGTGTTGACGCAGCCGCCCTCAGTGTCTGAGGCCCCAGGA CAGAAGGTCACCATCTCCTGCTCTGGAAGCAGCTCCAACATTGGG AATAATTATGTATCCTGGTACCAGCAGCTCCCAGGAACAGCCCCC AAACTCCTCATTTATGACAATAATAAGCGACCCTCAGGGATTCCTG ACCGATTCTCTGGCTCCAAGTCTGGCACGTCAGCCACCCTGGGCAT CACCGGACTCCAGACTGGGGACGAGGCCGATTATTACTGCGGAAC ATGGGATAGCCGCCTGAGTGCTGTGGTTTTCGGCGGAGGGACCAA GCTGACCGTCCTA | 529 |
| 60 | LV-114 | CAGTCTGTGCTGACTCAGCCACCCTCAGCGTCTGGGACCCCCGGGC AGAGAGTCACCATCTCTTGTTCTGGAAGCAGCTCCAACATCGGCA GTAATTATGTATACTGGTACCAGCAGCTCCCAGGAGCGGCCCCCA AACTCCTCATCTTTAGGAGTAATCAGCGGCCCTCAGGGGTCCCTGA CCGATTCTCTGGCTCCAAGTCTGGCACCTCAGCCTCCCTGGCCATC AGTGGGCTCCGGTCCGAGGATGAGGCTGATTATTACTGTCAGCA TGGGATGACAGCCTGAGTGGTTGGGTGTTCGGCGGAGGGACCAAG CTGACCGTCCTA | 530 |
| 61 | LV-115 | GACATCCAGATGACCCAGTCTCCATCCTCCCTGTCTGCATCTGTAG GAGACAGAGTCACCATCACTTGCCGGGCAAGTCAGGGCATTAGAA ATGATTTAGGCTGGTTTCAGCAGAAACCAGGGAAAGCCCCTAAGC GCCTGATCTATGCTGCATCCAGTTTGCAAAGTGGGGTCCCATCAAG GTTCAGCGGCAGTGGATCTGGGACAGAATTCACTCTCACAATCAG CAGCCTGCAGCCTGAAGATTTAGCAACTTATTACTGTCTACAGTAT AATATTTACCCGTGGACGTTCGGCCAAGGGACCAAGGTGGAAATC AAA | 531 |
| 62 | LV-116 | TCTTCTGAGCTGACTCAGGACCCTACTGTGTCTGTGGCCTTGGGAC AGACAGTCAAAATCACATGCCAAGGAGACAGCCTCAGAAGTTTTT ATGCAAGCTGGTACCAGCAGAAGCCAGGACAGGCCCCTGTACTTG TCTTCTATGGTAAAAACAACCGGCCCTCAGGGATCCCAGACCGAT TCTCTGGCTCCAGCTCAGGAAACACAGCTTCCTTGACCATCACTGG GGCTCAGGCGGAAGATGAGGCTGACTATTATTGTAATTCCCGGGA CAGCAGTGTTTACCATCTGGTACTCGGCGGAGGGACCAAGCTGAC CGTCCTA | 532 |
| 63 | LV-117 | GATATTATACTGGCCCAGACTCCACTTTCTCTGTCCGTCACCCCTG GACAGCCGGCCTCCATCTCCTGCAAGTCTAGTCAGAGCCTCCTGCA CAGTGCTGGAAAGACCTATTTGTATTGGTACCTGCAGAAGCCAGG CCAGCCTCCACAGCTCCTGATCTATGAAGTTTCCAACCGGTTCTCT GGAGTGCCAGATAGGTTCAGTGGCAGCGGGTCAGGGACAGATTTC ACACTGAAAATCAGCCGGGTGGAGGCTGAGGATGTTGGGATTTAT TACTGCATGCAAAGTTTTCCGCTTCCGCTCACTTTCGGCGGAGGGA CCAAGGTGGAGATCAAA | 533 |
| 64 | LV-118 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTTTTGGGTACAACTATTTGGATTGGTACCTGCAGAAGCCAGGG CAGTCTCCACAGCTCCTGATCTATTTGGGTTCTAATCGGGCCTCCG GGGTCCCTGACAGGTTCAGTGGCAGTGGATCAGGCACAGATTTTA CACTGAAAATCAGCAGAGTGGAGGCTGAGGATGTTGGGGTTTATT ACTGCATGCAAGCTCTACAAACTCCATTCACTTTCGGCCCTGGGAC CAAAGTGGATATCAAA | 534 |
| 65 | LV-119 | GATATTATTCTGACCCAGACTCCACTTTCTCTGTCCGTCACCCCTG GACAGCCGGCCTCCATCTCCTGCAAGTCTAGTCAGAGCCTCCTGCA CAGTGATGGAAAGACCTATTTGTATTGGTACCTGCAGAAGCCCGG CCAGCCTCCACAGCTCCTGATCTATGAAGTTTCCAACCGGTTCTCT | 535 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| | | GGAGAGCCAGATAGGTTCAGTGGCAGCGGGTCAGGGACAGATTTC ACACTGAAAATCAGCCGGGTGGAGGCTGAGGATGTTGGGACTTAT TATTGCATGCAAAGTTTTCCGCTTCCGCTCACTTTCGGCGGAGGGA CCAAGGTGGAGATCAAA | |
| 66 | LV-120 | CAGTCTGTGTTGACGCAGCCGCCCTCAGTGTCTGCGGCCCCAGGAC AGAAGGTCACCATCTCCTGCTCTGGAAGCAGCTCCAACATTGGGA ATAATTATGTATCCTGGTACCAGCAGTTCCCAGGAACAGCCCCCA AACTCCTCATTTATGACAATAATAAGCGACCCTCAGGGATTCCTGA CCGATTCTCTGGCTCCAAGTCTGGCACGTCAGCCACCCTGGGCATC ACCGGACTCCAGACTGGGGACGAGGCCGATTATTACTGCGAACA TGGGATAGCCGCCTGAGTGCTGTGGTTTTCGGCGGAGGGACCAAG CTGACCGTCCTA | 536 |
| 67 | LV-121 | CAGTCTGTGCTGACTCAGCCACCCTCAGCGTCTGGGACCCCCGGGC AGAGGGTCACCATCTCTTGTTCTGGAAGCAGTTCCAATATCGGAA GTAATACTGTGAACTGGTACCAGCAGCTCCCAGGAACGGCCCCCA AACTCCTCATCTATACTAATAATCAGCGGCCCTCAGGGGTCCCTGA CCGATTCTCTGGCTCCAAGTCTGGCACCTCAGCCTCCCTGGCCATC AGTGGACTCCAGTCTGAGGATGAGGCTGATTTTTACTGTGCAGCGC GGGATGAGAGCCTGAATGGTGTGGTATTCGGCGGAGGGACCAAGC TGACCGTCCTA | 537 |
| 68 | LV-122 | GATATTACACTGACCCAGACTCCACTTTCTCTGTCCGTCTCCCCTG GACAGCCGGCCTCCATCTCCTGCAAGTCTAGTCAGAGCCTCCTGCA CAGTGATGGAAGGAACTATCTGTATTGGTACCTGCAGAAGCCAGG CCAGCCTCCACAGCTCCTGATCTATGAAGTGTCCAACCGGTTCTCT GGACTGCCAGATAGGTTCAGTGGCAGCGGGTCAGGGACAGATTTC ACACTGAAAATCAGCCGGGTGGAGGCTGAGGATGTTGGGATTTAT TACTGCATGCAAAGTTTTCCGCTTCCGCTCACTTTCGGCGGAGGGA CCAAGGTGGAGATCAAA | 538 |
| 69 | LV-123 | GACATCCAGATGACCCAGTCTCCATCCTCCCTGTCTGCATCTGTAG GAGACAGAGTCACCATCACTTGCCGGGCAAGTCAGGGCATTAGAA AGGATTTAGGCTGGTATCAGCAGAAACCAGGGAAAGCCCCTAAGC GCCTGATCTATGAGCATCCAGTTTGCAAAGTGGGGTCCCATCAA GGTTCAGCGGCAGTGGATCTGGGACAGAATTCACTCTCACAATCA GCAGCCTGCAGCCTGAAGATTTTGCAACTTATTACTGTCTACAGTA TAATAGTTTCCCCGTGGACGTTCGGCCAAGGGACCAAGGTGGAAAT CAAA | 539 |
| Heavy chain variable regions | | | |
| 50A, 50C, 50D | HV-101 | GAGGTACAGCTGGTGGAGTCTGGGGGAGGCTTGGTAAAGCCTGGG GGGTCCCTCAGACTCTCCTGTGCAGCCTCTGGATTCACTTTCGGTA ACGCCTGGATGAGCTGGGTCCGCCAGGCTCCAGGGAAGGGGCTGG AGTGGGTTGGCCGTATTAAAAGCAAACTGATGGTGGGACAACAG ACTACGCTGCACCCGTGAAAGGCAGATTCACCATCTCAAGAGATG ATTCAAAAAACACGCTGTATCTGCAAATGAACAGCCTGAAAACCG AGGACACAGCCGTGTATTTCTGTACCACAGATCGGACCGGGTATA GCATCAGCTGGTCTAGTTACTACTACTACTACGGTATGGACGTCTG GGGCCAAGGAACAACAGTTACCGTCTCTAGT | 540 |
| 50B | HV-102 | GAGGTACAGCTGGTGGAGTCTGGGGGAGGCTTGGTAAAGCCTGGG GGGTCCCTCAGACTCTCCTGTGCAGCCTCTGGATTCACTTTCGGTA ACGCCTGGATGAGCTGGGTCCGCCAGGCTCCAGGGAAGGAGCTGG AGTGGGTTGGCCGTATTAAAAGCAAACTGATGGTGGGACAACAG ACTACGCTGCACCCGTGAAAGGCAGATTCACCATCTCAAGAGATG ATTCAAAAAACACGCTGTATCTGCAAATGAACAGCCTGAAAACCG AGGACACAGCCGTGTATTTCTGTACCACAGATCGGACCGGGTATA GCATCAGCTGGTCTAGTTACTACTACTACTACGGTATGGACGTCTG GGGCCAAGGAACAACAGTTACCGTCTCTAGT | 541 |
| 51A, 51C, 51D | HV-103 | GAGGTGCAGCTGGTGGAGTCTGGGGGAGGCTTGGTAAAGCCTGGG GGGTCCCTTAGACTCTCCTGTGCAGCCTCTGGATTCACTTTCAGTA ACGCCTGGATGAGCTGGGTCCGCCAGGCTCCAGGGAAGGGGCTGG AGTGGGTTGGCCGTATTAAAAGCAAACTGATGGTGGGACAACAG ACTACACTGCACCCGTGAAAGGCAGATTCACCATCTCAAGAGATG ATTCAAAAAACACGCTGTATCTGCAAATGAATAGCCTGAAAGCCG AGGACACAGCCGTGTATTACTGTACCACAGATCGGACCGGGTATA GCATCAGCTGGTCTAGTTACTACTACTACTACGGTATGGACGTCTG GGGCCAAGGAACAACAGTTACCGTCTCTAGT | 542 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| 51B | HV-104 | GAGGTGCAGCTGGTGGAGTCTGGGGGAGGCTTGGTAAAGCCTGGG GGGTCCCTTAGACTCTCCTGTGCAGCCTCTGGATTCACTTTCAGTA ACGCCTGGATGAGCTGGGTCCGCCAGGCTCCAGGGAAGGAGCTGG AGTGGGTTGGCCGTATTAAAAGCAAAACTGATGGTGGGACAACAG ACTACACTGCACCCGTGAAAGGCAGATTCACCATCTCAAGAGATG ATTCAAAAAACACGCTGTATCTGCAAATGAATAGCCTGAAAGCCG AGGACACAGCCGTGTATTACTGTACCACAGATCGGACCGGGTATA GCATCAGCTGGTCTAGTTACTACTACTACGGTATGGACGTCTG GGGCCAAGGAACAACAGTTACCGTCTCTAGT | 543 |
| 52A, 52C, 52D, 54A, 54C, 55A, 55C, 59, 66 | HV-105 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGCAAGGGGCTGG AGTGGGTGGCAGTTATATCATTTGATGGAAGTATTAAGTATTCGT AGACTCCGTGAAGGGCCGATTCACCATCTCCAGAGACAATTCAA GAACACGCTGTTTCTGCAAATGAACAGCCTGCGAGCCGAGGACAC GGCTGTGTATTACTGTGCGAGAGATCGGCTCAATTACTATGATAGT AGTGGTTATTATCACTACAAATACTACGGTATGGCCGTCTGGGGCC AAGGGACAACAGTTACCGTCTCTAGT | 544 |
| 52B, 54B, 55B | HV-106 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGGAAGGAGCTGG AGTGGGTGGCAGTTATATCATTTGATGGAAGTATTAAGTATTCTGT AGACTCCGTGAAGGGCCGATTCACCATCTCCAGAGACAATTCAA GAACACGCTGTTTCTGCAAATGAACAGCCTGCGAGCCGAGGACAC GGCTGTGTATTACTGTGCGAGAGATCGGCTCAATTACTATGATAGT AGTGGTTATTATCACTACAAATACTACGGTATGGCCGTCTGGGGCC AAGGGACAACAGTTACCGTCTCTAGT | 545 |
| 53A, 53C, 56A, 56C | HV-107 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGCAAGGGGCTGG AGTGGGTGGCAGTTATATCATTTGATGGAAGTATTAAGTATTCTGT AGACTCCGTGAAGGGCCGATTCACCATCTCCAGAGACAATTCAA GAACACGCTGTTTCTGCAAATGAACAGCCTGCGAGCCGAGGACAC GGCTGTGTATTACTGTGCGAGAGATCGGCTCAATTACTATGAGAGT AGTGGTTATTATCACTACAAATACTACGGTATGGCCGTCTGGGGCC AAGGGACAACAGTTACCGTCTCTAGT | 546 |
| 53B, 56B | HV-108 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCACTGGGTCCGCCAGGCTCCAGGGAAGGAGCTGG AGTGGGTGGCAGTTATATCATTTGATGGAAGTATTAAGTATTCTGT AGACTCCGTGAAGGGCCGATTCACCATCTCCAGAGACAATTCAA GAACACGCTGTTTCTGCAAATGAACAGCCTGCGAGCCGAGGACAC GGCTGTGTATTACTGTGCGAGAGATCGGCTCAATTACTATGAGAGT AGTGGTTATTATCACTACAAATACTACGGTATGGCCGTCTGGGGCC AAGGGACAACAGTTACCGTCTCTAGT | 547 |
| 57A, 57C, 57D | HV-109 | CAGGTGCAGCTGGTGGAGTCTGGGGGAGGCGTGGTCCAGCCTGGG AGGTCCCTGAGACTCTCCTGTGCAGCGTCTGGATTCACCTTCAGTA GCTATGGCATGCACTGGGTCCGCCAGGCTCCAGGCAAGGGGCTGG AGTGGGTGGCAGTTATATGGTATGATGGAAGTAATAAATACTATG CAGACTCCGTGAAGGGCCGATTCATCATCTCCAGAGATAAATCCA AGAACACGCTGTATCTGCAAATGAACAGCCTGAGAGCCGAGGACA CGGCTGTGTATTACTGTGCGAGAGCGGGGGGTATAGCAGCAGCTG GCCTCTACTACTACTACGGTATGGACGTCTGGGGCCAAGGGACAA CAGTTACCGTCTCTAGT | 548 |
| 57B | HV-110 | CAGGTGCAGCTGGTGGAGTCTGGGGGAGGCGTGGTCCAGCCTGGG AGGTCCCTGAGACTCTCCTGTGCAGCGTCTGGATTCACCTTCAGTA GCTATGGCATGCACTGGGTCCGCCAGGCTCCAGGGAAGGAGCTGG AGTGGGTGGCAGTTATATGGTATGATGGAAGTAATAAATACTATG CAGACTCCGTGAAGGGCCGATTCATCATCTCCAGAGATAAATCCA AGAACACGCTGTATCTGCAAATGAACAGCCTGAGAGCCGAGGACA CGGCTGTGTATTACTGTGCGAGAGCGGGGGGTATAGCAGCAGCTG GCCTCTACTACTACTACGGTATGGACGTCTGGGGCCAAGGGACAA CAGTTACCGTCTCTAGT | 549 |
| 58A, 58C | HV-111 | CAGGTGCAGCTGGTGGAGTCTGGGGGAGGCGTGGTCCAGCCTGGG AGGTCCCTGAGACTCTCCTGTGCAGCGTCTGGATTCACCTTCAGTA GCTATGGCATGCACTGGGTCCGCCAGGCTCCAGGCAAGGGGCTGG | 550 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| | | AGTGGGTGGCAGTTATATGGTATGATGGAAGTAATAAATACTATG CAGAGTCCGTGAAGGGCCGATTCATCATCTCCAGAGATAAATCCA AGAACACGCTGTATCTGCAAATGAACAGCCTGAGAGCCGAGGACA CGGCTGTGTATTACTGTGCGAGAGCGGGGGGTATAGCAGCAGCTG GCCTCTACTACTACTACGGTATGGACGTCTGGGGCCAAGGGACAA CAGTTACCGTCTCTAGT | |
| 58B | HV-112 | CAGGTGCAGCTGGTGGAGTCTGGGGGAGGCGTGGTCCAGCCTGGG AGGTCCCTGAGACTCTCCTGTGCAGCGTCTGGATTCACCTTCAGTA GCTATGGCATGCACTGGGTCCGCCAGGCTCCAGGGAAGGAGCTGG AGTGGGTGGCAGTTATATGGTATGATGGAAGTAATAAATACTATG CAGAGTCCGTGAAGGGCCGATTCATCATCTCCAGAGATAAATCCA AGAACACGCTGTATCTGCAAATGAACAGCCTGAGAGCCGAGGACA CGGCTGTGTATTACTGTGCGAGAGCGGGGGGTATAGCAGCAGCTG GCCTCTACTACTACTACGGTATGGACGTCTGGGGCCAAGGGACAA CAGTTACCGTCTCTAGT | 551 |
| 60 | HV-113 | GAGGTGCAGCTGGTGGAGTCTGGGGGAGGCTTGGTAAAGCCTGGG GGGTCCCTTAGACTCTCCTGTGCAGCCTCTGGATTCACTTTCAGTA ACGCCTGGATGAGCTGGGTCCGCCAGGCTCCAGGGAAGGGGCTGG AGTGGGTTGGCCGTATTAAAAGCACAACTGATGGTGGGACAACAG ACTACGCTGCACCCGTGAAAGGCAGATTCACCATCTCAAGAGATG ATTCAAAAAACACGCTGTATCTGCAAATGAACAGCCTGAAAACCG AGGACACAGCCGTGTATTACTGTACCACAGATCGGACCGGATATA GCATCAGCTGGTCTAGTTACTACTACTACTACGGTATGGACGTCTG GGGCCAAGGGACCACGGTCACCGTCTCTAGT | 552 |
| 61 | HV-114 | GAGGTGCAGCTATTGGAGTCTGGGGGAGGCTTGGTACAGCCTGGG GAGTCCCTGAGACTCTCCTGTGCAGCCTCTGGGTTCACCTTTAGCA GCTATGCCATGAGCTGGGTCCGCCAGGCTCCAGGGAAGGGGCTGG AGTGGGTCTCAGCTATTAGTGGTAGTGGTGGTCGCACATACTACGC AGACTCCGTGAAGGGCCGGTTCACCATCTCCAGAGACAATTCCAA GAACACGCTGTATCTGCAAATGAATAGCCTGAGAGCCGAGGACAC GGCCGTATATTACTGTGCGAAAGATCAAAGGGAGGTAGGGCCGTA TAGCAGTGGCTGGTACGACTACTACTACGGTATGGACGTCTGGGG CCAAGGGACCACGGTCACCGTCTCTAGT | 553 |
| 62 | HV-115 | CAGGTGCAGTTGGTGCAGTCTGGGGCTGAGGTGAAGAAGCCTGGG GCCTCAGTGAAGGTCTCCTGCAAGGCTTCTGGATACACCTTCACCG GCTACTATATGCACTGGGTGCGACAGGCCCCTGGACAAGGGCTTG AGTGGATGGGATGGATCAACCCTAACAGTGGTGGCACAAACTATG CACAGAAGTTTCAGGGCAGGGTCACCATGACCAGGGACACGTCCA TCAGCACAGCCTACATGGAGCTGAGCAGGCTGAGATCTGACGACA CGGCCGTGTATTTCTGTGCGAGAGATCAAATGAGTATTATTATGCT TCGGGGAGTTTTTCCCCCTTACTATTACGGTATGGACGTCTGGGGC CAAGGGGACCACGGTCACCGTCTCTAGT | 554 |
| 63, 65, 68 | HV-116 | CAGGTGCAGCTGGTGGAGTCTGGGGGAGGCGTGGTCCAGCCTGGG AGGTCCCTGAGACTCTCCTGTGCAGCCTCTGGATTCACCTTCAGTA GCTATGGCATGCACTGGGTCCGCCAGGCTCCAGGCAAGGGGCTGG AGTGGGTGGCAGTTATTTCATATGATGGAAGTCATGAATCCTATGC AGACTCCGTGAAGGGCCGATTCACCATCTCCAGAGACATTTCCAA GAACACGCTGTATCTGCAAATGAACAGCCTGAGAGCTGAGGACAC GGCTGTGTATTTCTGTGCGAGAGAGAGGAAACGGGTTACGATGTC TACCTTATATTACTACTTCTACTACGGTATGGACGTCTGGGGCCAA GGGACCACGGTCACCGTCTCTAGT | 555 |
| 64 | HV-117 | GAGGTGCAGCTGGTGGAGTCTGGGGGAGGCTTGGTAAAGCCAGGG CGGTCCCTGAGACTCTCCTGTACAGCTTCTGGATTCACCTTTGGTG ATTATGCTATGAGCTGGTTCCGCCAGGCTCCAGGGAAGGGGCTGG AGTGGATAGGTTTCATTAGAAGCAGAGCTTATGGTGGGACACCAG AATACGCCGCGTCTGTGAAAGGCAGATTCACCATCTCAAGAGATG ATTCCAAAACCATCGCCTATCTGCAAATGAACAGCCTGAAAACCG AGGACACAGCCGTGTATTTCTGTGCTAGAGGACGGGGTATTGCAG CTCGTTGGGACTACTGGGGCCAGGGAACCCTGGTCACCGTCTCTA GT | 556 |
| 67 | HV-118 | CAGGTGCAGCTGGTGCAGTCTGGGGCTGAGGTGAAGAAGCCTGGG GCCTCAGTGAAGGTCTCCTGCAAGGCTTCTGGATACACCTTCACCG ACTATATATGTACTGGGTGCGACAGGCCCCTGGACAAGGGCTTG AGTGGATGGGATGGATCAGCCCTAATAGTGGTGGCACAAACTATG CCCAGAAGTTCAGGGCAGGGTCACCATGACCAGGGACACGTCTA TCAGCACAGCCTACATGGAGCTGAGTAGGCTGAGATCTGACGACA CGGCCGTGTATTACTGTGTGAGAGGAGGATATAGTGGCTACGCTG | 557 |

TABLE 12-continued

Exemplary Anti-CGRP Receptor Variable Region Nucleic Acid Sequences

| Antibody ID | Designation | Nucleic Acid Sequence | SEQ ID NO: |
|---|---|---|---|
| | | GGCTCTACTCCCACTACTACGGTATGGACGTCTGGGGCCAAGGGA CCACGGTCACCGTCTCTAGT | |
| 69 | HV-119 | GAGGTGCAGCTGGTGGAGTCTGGGGGAGGCCTGGTCAAGCCTGGG GGGTCCCTGAGACTCTCCTGTGCAGCCTCTGGATACACCTTCAGTA CCTATAGCATGAACTGGGTCCGCCAGGCTCCAGGGAAGGGGCTGG AGTGGGTCTCATCCATTAGTAGTAGTAGTTACAGATATTACGC AGACTCAGTGAAGGGCCGATTCACCATCTCCAGAGACAACGCCAA GAACTCACTGTATCTGCAAATGAGTAGCCTGAGAGCCGAGGACAC GGCTGTGTATTACTGTGCGAGAGAAGGGGTGTCTGGCAGTTCGCC GTATAGCATCAGCTGGTACGACTACTATTACGGTATGGACGTCTGG GGCCAAGGGACCACGGTCACCGTCTCTAGT | 558 |
| 70 | HV-120 | GAGGTACAGCTGGTGGAGTCTGGGGGAGGCTTGGTAAAGCCTGGG GGGTCCCTTAGACTCTCCTGTGCAGCCTCTGGATTCACTTTCGGTA ACGCCTGGATGAGCTGGGTCCGCCAGGCTCCAGGGAAGGGGCTGG AGTGGGTTGGCCGTATTAAAAGCAAAACTGATGGTGGGACAACAG ACTACGCTGCACCCGTGAAAGGCAGATTCACCATCTCAAGAGATG ATTCAAAAAACACGCTGTATCTGCAAATGAACAGCCTGAAAACCG AGGACACAGCCGTGTATTACTGTACCACAGATCGGACCGGGTATA GCATCAGCTGGTCTAGTTACTACTACTACTACGGTATGGACGTCTG GGGCCAAGGGACCACGGTCACCGTCTCTAGT | 559 |
| 71 | HV-121 | CAGGTGCAGCTGGTGGAATCTGGGGGAGGCGTGGTCCAGCCTGGG AGGTCCCTGAGACTCTCCTGTGCAGCCTCTGGATTCACCTTCAGTA GCTTTGGCATGCATTGGGTCCGCCAGGCTCCAGGCAAGGGGCTGG AGTGGGTGGCAGTTATATCATTTGATGGAAGTATTAAGTACTCTGT AGACTCCGTGAAGGGCCGATTCACCATCTCCAGAGACAATTCAAA GAACACGCTGTTTCTGCAAATGAACAGCCTGCGAGCCGAGGACAC GGCTGTGTATTACTGTGCGAGAGATCGGCTCAATTACTATGATAGT AGTGGTTATTATCACTACAAATACTACGGTCTGGCCGTCTGGGGCC AAGGGACCACGGTCACCGTCTCTAGT | 560 |

Isolated nucleic acids encoding anti-PAC1 receptor binding domains of the bispecific antigen binding proteins of the invention may comprise a nucleotide sequence that is at least 80% identical, at least 90% identical, at least 95% identical, or at least 98% identical to any of the nucleotide sequences listed in Table 11. In some embodiments, an isolated nucleic acid encoding an anti-PAC1 receptor light chain variable region comprises a sequence selected from SEQ ID NOs: 464 to 490. In related embodiments, an isolated nucleic acid encoding an anti-PAC1 receptor heavy chain variable region comprises a sequence selected from SEQ ID NOs: 491 to 516. Isolated nucleic acids encoding anti-CGRP receptor binding domains of the bispecific antigen binding proteins of the invention may comprise a nucleotide sequence that is at least 80% identical, at least 90% identical, at least 95% identical, or at least 98% identical to any of the nucleotide sequences listed in Table 12. In some embodiments, an isolated nucleic acid encoding an anti-CGRP receptor light chain variable region comprises a sequence selected from SEQ ID NOs: 517 to 539. In related embodiments, an isolated nucleic acid encoding an anti-CGRP receptor heavy chain variable region comprises a sequence selected from SEQ ID NOs: 540 to 560.

In embodiments in which the bispecific antigen binding protein of the invention is a heterodimeric antibody, the isolated nucleic acid encoding an anti-PAC1 receptor antibody light chain may comprise a nucleotide sequence that is at least 80% identical, at least 90% identical, at least 95% identical, or at least 98% identical to any of the nucleotide sequences listed in Table 6A. In certain embodiments, the isolated nucleic acid encoding an anti-PAC1 receptor light chain of a heterodimeric antibody of the invention comprises a sequence selected from SEQ ID NOs: 222 to 232. In these and other embodiments, the isolated nucleic acid encoding an anti-PAC1 receptor antibody heavy chain may comprise a nucleotide sequence that is at least 80% identical, at least 90% identical, at least 95% identical, or at least 98% identical to any of the nucleotide sequences listed in Table 6B. In some embodiments, the isolated nucleic acid encoding an anti-PAC1 receptor heavy chain of a heterodimeric antibody of the invention comprises a sequence selected from SEQ ID NOs: 252 to 270.

In other embodiments in which the bispecific antigen binding protein of the invention is a heterodimeric antibody, the isolated nucleic acid encoding an anti-CGRP receptor antibody light chain may comprise a nucleotide sequence that is at least 80% identical, at least 90% identical, at least 95% identical, or at least 98% identical to any of the nucleotide sequences listed in Table 7A. In certain embodiments, the isolated nucleic acid encoding an anti-CGRP receptor light chain of a heterodimeric antibody of the invention comprises a sequence selected from SEQ ID NOs: 283 to 294. In these and other embodiments, the isolated nucleic acid encoding an anti-CGRP receptor antibody heavy chain may comprise a nucleotide sequence that is at least 80% identical, at least 90% identical, at least 95% identical, or at least 98% identical to any of the nucleotide sequences listed in Table 7B. In some embodiments, the isolated nucleic acid encoding an anti-CGRP receptor heavy chain of a heterodimeric antibody of the invention comprises a sequence selected from SEQ ID NOs: 317 to 338.

Nucleic acid sequences encoding the light chains and modified heavy chains (e.g., fusion proteins comprising a heavy chain and a scFv) of exemplary bispecific antigen binding proteins of the invention in the IgG-scFv format are listed in Table 13. In such embodiments, the isolated nucleic acid encoding the light chain of the IgG-scFv molecules may comprise a nucleotide sequence that is at least 80% identical, at least 90% identical, at least 95% identical, or at least 98% identical to any of the light chain nucleotide sequences listed in Table 13. For instance, in some embodiments, the isolated nucleic acid encoding the light chain of the IgG-scFv molecules comprises a sequence selected from SEQ ID NOs: 561 to 564. In related embodiments, the isolated nucleic acid encoding the modified heavy chain of the IgG-scFv molecules may comprise a nucleotide sequence that is at least 80% identical, at least 90% identical, at least 95% identical, or at least 98% identical to any of the modified heavy chain nucleotide sequences listed in Table 13. In certain embodiments, the isolated nucleic acid encoding the modified heavy chain of the IgG-scFv molecules comprises a sequence selected from SEQ ID NOs: 565 to 594.

TABLE 13

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | Anti-PAC1 Receptor IgG x Anti-CGRP Receptor scFv | |
| iPS:386738 | GATATCCAGCTCAC TCAATCGCCATCAT TTCTCTCCGCTTCG GTAGGCGACCGGG TCACGATCACATGC AGGGCGTCGCAAA GCATTGGGAGGTCG TTGCATTGGTATCA GCAGAAACCCGGA AAGGCCCCGAAAC TTCTGATCAAATAC GCATCACAAAGCTT GAGCGGTGTGCCGT CGCGCTTCTCCGGT TCCGGAAGCGGAA CGGAATTCACGCTT ACAATCTCCTCACT GCAGCCCGAGGATT TCGCGACCTATTAC TGTCACCAGTCATC CAGACTCCCGTTTA CTTTTGGCCCTGGG ACCAAGGTGGACA TTAAGCGTACGGTG GCTGCACCATCTGT CATCTGATGAGCAG TTGAAATCTGGAAC TGCCTCTGTTGTGT GCCTGCTGAATAAC TTCTATCCCAGAGA GGCCAAAGTACAG TGGAAGGTGGATA ACGCCCTCCAATCG GGTAACTCCCAGGA GAGTGTCACAGAG CAGGACAGCAAGG ACAGCACCTACAGC CTCAGCAGCACCCT GACGCTGAGCAAA GCAGACTACGAGA AACACAAAGTCTAC GCCTGCGAAGTCAC CCATCAGGGCCTGA GCTCGCCCGTCACA AAGAGCTTCAACA GGGGAGAGTGT (SEQ ID NO: 561) | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGTGTCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGATAGTAGTG GTTATTATCACTACAAATACTACGGTATGGCCGTCTGGGGCC AAGGGACAACAGTTACTGTCTCTAGTGGAGGCGGAGGATCT GGTGGCGGTGGTTCTGGCGGCGGAGGCTCCCAGTCTGTGTTG ACGCAGCCGCCCTCAGTGTCTGCGGCCCCAGGACAGAAGGT CACCATCTCCTGCTCTGGAAGCAGCTCCAACATTGGGAATAA TTATGTATCCTGGTACCAGCAGCTCCCAGGAACAGCCCCAA ACTCCTCATTTATGACAATAATAAGCGACCCTCAGGGATTCC TGACCGATTCTCTGGCTCCAAGTCTGGCACGTCAACCACCCT GGGCATCACCGGACTCCAGACTGGGGACGAGGCCGATTATT ACTGCGGAACATGGGATAGCCGCCTGAGTGCTGTGGTTTTCG GCTGTGGGACCAAGCTGACCGTGCTA (SEQ ID NO: 565) |
| iPS:386764 | SEQ ID NO: 561 | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCG GTCAGGGGTTGGAGTGGATGGGAGTTATTAGCTATGACGGG GGCAATAAGTACTACGCCGAGTCTGTTAAGGGTCGGGTCAC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGTCTGTGTTGACGCAGCCGCCCTCAGTGT<br>CTGCGGCCCCAGGACAGAAGGTCACCATCTCCTGCTCTGGA<br>AGCAGCTCCAACATTGGGAATAATTATGTATCCTGGTACCAG<br>CAGCTCCCAGGAACAGCCCCCAAACTCCTCATTTATGACAAT<br>AATAAGCGACCCTCAGGGATTCCTGACCGATTCTCTGGCTCC<br>AAGTCTGGCACGTCAGCCACCCTGGGCATCACCGGACTCCA<br>GACTGGGGACGAGGCCGATTATTACTGCGGAACATGGGATA<br>GCCGCCTGAGTGCTGTGGTTTTCGGCGGAGGGACCAAGCTG<br>ACCGTGCTTGGAGGCGGAGGATCTGGTGGCGGTGGTTCTGG<br>CGGCGGAGGCTCCCAGGTGCAGCTGGTGGAATCTGGGGGAG<br>GCGTGGTCCAGCCTGGGAGGTCCCTGAGACTCTCCTGTGCAG<br>CCTCTGGATTCACCTTCAGTAGCTTTGGCATGCACTGGGTCC<br>GCCAGGCTCCAGGCAAGGGGCTGGAGTGGGTGGCAGTTATA<br>TCATTTGATGGAAGTATTAAGTATTCTGTAGACTCCGTGAAG<br>GGCCGATTCACCATCTCCAGAGACAATTCAAAGAACACGCT<br>GTTTCTGCAAATGAACAGCCTGCGAGCCGAGGACACGGCTG<br>TGTATTACTGTGCGAGAGATCGGCTCAATTACTATGATAGTA<br>GTGGTTATTATCACTACAAATACTACGGTATGGCCGTCTGGG<br>GCCAAGGGACAACAGTTACTGTCTCTAGT<br>(SEQ ID NO: 566) |
| iPS:386762 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGTCTGTGTTGACGCAGCCGCCCTCAGTGT<br>CTGCGGCCCCAGGACAGAAGGTCACCATCTCCTGCTCTGGA<br>AGCAGCTCCAACATTGGGAATAATTATGTATCCTGGTACCAG<br>CAGCTCCCAGGAACAGCCCCCAAACTCCTCATTTATGACAAT<br>AATAAGCGACCCTCAGGGATTCCTGACCGATTCTCTGGCTCC<br>AAGTCTGGCACGTCAGCCACCCTGGCCATCACCGGACTCCA<br>GACTGGGGACGAGGCCGATTATTACTGCGGAACATGGGATA<br>GCCGCCTGAGTGCTGTGGTTTTCGGCGGAGGGACCAAGCTG<br>ACCGTGCTTGGAGGCGGAGGATCTGGTGGCGGTGGTTCTGG<br>CGGCGGAGGCTCCCAGGTGCAGCTGGTGGAATCTGGGGGAG<br>GCGTGGTCCAGCCTGGGAGGTCCCTGAGACTCTCCTGTGCAG<br>CCTCTGGATTCACCTTCAGTAGCTTTGGCATGCACTGGGTCC<br>GCCAGGCTCCAGGCAAGGGGCTGGAGTGGGTGGCAGTTATA<br>TCATTTGATGGAAGTATTAAGTATTCTGTAGACTCCGTGAAG<br>GGCCGATTCACCATCTCCAGAGACAATTCAAAGAACACGCT<br>GTTTCTGCAAATGAACAGCCTGCGAGCCGAGGACACGGCTG<br>TGTATTACTGTGCGAGAGATCGGCTCAATTACTATGATAGTA<br>GTGGTTATTATCACTACAAATACTACGGTATGGCCGTCTGGG<br>GCCAAGGGACAACAGTTACTGTCTCTAGT<br>(SEQ ID NO: 567) |
| iPS:386760 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGTCTGTGTTGACGCAGCCGCCCTCAGTGT<br>CTGCGGCCCCAGGACAGAAGGTCACCATCTCCTGCTCTGGA<br>AGCAGCTCCAACATTGGGAATAATTATGTATCCTGGTACCAG<br>CAGCTCCCAGGAACAGCCCCCAAACTCCTCATTTATGACAAT<br>AATAAGCGACCCTCAGGGATTCCTGACCGATTCTCTGGCTCC<br>AAGTCTGGCACGTCAGCCACCCTGGCCATCACCGGACTCCA<br>GACTGGGGACGAGGCCGATTATTACTGCGGAACATGGGATA<br>GCCGCCTGAGTGCTGTGGTTTTCGGCGGAGGGACCAAGCTG<br>ACCGTGCTTGGAGGCGGAGGATCTGGTGGCGGTGGTTCTGG<br>CGGCGGAGGCTCCCAGGTGCAGCTGGTGGAATCTGGGGGAG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | GCGTGGTCCAGCCTGGGAGGTCCCTGAGACTCTCCTGTGCAG<br>CCTCTGGATTCACCTTCAGTAGCTTTGGCATGCACTGGGTCC<br>GCCAGGCTCCAGGCAAGGGGCTGGAGTGGGTGGCAGTTATA<br>TCATTTGATGGAAGTATTAAGTATTCTGTAGACTCCGTGAAG<br>GGCCGATTCACCATCTCCAGAGACAATTCAAAGAACACGCT<br>GTTTCTGCAAATGAACAGCCTGCGAGCCGAGGACACGGCTG<br>TGTATTACTGTGCGAGAGATCGGCTCAATTACTATGAAAGTA<br>GTGGTTATTATCACTACAAATACTACGGTATGGCCGTCTGGG<br>GCCAAGGGACAACAGTTACTGTCTCTAGT<br>(SEQ ID NO: 568) |
| iPS:386758 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGTCTGTGTTGACGCAGCCGCCCTCAGTGT<br>CTGCGGCCCCAGGACAGAAGGTCACCATCTCCTGCTCTGGA<br>AGCAGCTCCAACATTGGGAATAATTATGTATCCTGGTACCAG<br>CAGCTCCCAGGAACAGCCCCCAAACTCCTCATTTATGACAAT<br>AATAAGCGACCCTCAGGGATTCCTGACCGATTCTCTGGCTCC<br>AAGTCTGGCACGTCAACCACCCTGGGCATCACCGGACTCCA<br>GACTGGGGACGAGGCCGATTATTACTGCGGAACATGGGATA<br>GCCGCCTGAGTGCTGTGGTTTTCGGCGGAGGGACCAAGCTG<br>ACCGTGCTTGGAGGCGGAGGATCTGGTGGCGGTGGTTCTGG<br>CGGCGGAGGCTCCCAGGTGCAGCTGGTGGAATCTGGGGGAG<br>GCGTGGTCCAGCCTGGGAGGTCCCTGAGACTCTCCTGTGCAG<br>CCTCTGGATTCACCTTCAGTAGCTTTGGCATGCACTGGGTCC<br>GCCAGGCTCCAGGCAAGGGGCTGGAGTGGGTGGCAGTTATA<br>TCATTTGATGGAAGTATTAAGTATTCTGTAGACTCCGTGAAG<br>GGCCGATTCACCATCTCCAGAGACAATTCAAAGAACACGCT<br>GTTTCTGCAAATGAACAGCCTGCGAGCCGAGGACACGGCTG<br>TGTATTACTGTGCGAGAGATCGGCTCAATTACTATGAAAGTA<br>GTGGTTATTATCACTACAAATACTACGGTATGGCCGTCTGGG<br>GCCAAGGGACAACAGTTACTGTCTCTAGT<br>(SEQ ID NO: 569) |
| iPS:386756 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | GGCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGTCTGTGTTGACGCAGCCGCCCTCAGTGT CTGCGGCCCCAGGACAGAAGGTCACCATCTCCTGCTCTGGA AGCAGCTCCAACATTGGGAATAATTATGTATCCTGGTACCAG CAGCTCCCAGGAACAGCCCCCAAACTCCTCATTTATGACAAT AATAAGCGACCCTCAGGGATTCCTGACCGATTCTCTGGCTCC AAGTCTGGCACGTCAACCACCCTGGGCATCACCGGACTCCA GACTGGGGACGAGGCCGATTATTACTGCGGAACATGGGATA GCCGCCTGAGTGCTGTGGTTTTCGGCGGAGGGACCAAGCTG ACCGTGCTTGGAGGCGGAGGATCTGGTGGCGGTGGTTCTGG CGGCGGAGGCTCCCAGGTGCAGCTGGTGGAATCTGGGGGAG GCGTGGTCCAGCCTGGGAGGTCCCTGAGACTCTCCTGTGCAG CCTCTGGATTCACCTTCAGTAGCTTTGGCATGCACTGGGTCC GCCAGGCTCCAGGCAAGGGGCTGGAGTGGGTGGCAGTTATA TCATTTGATGGAAGTATTAAGTATTCTGTAGACTCCGTGAAG GGCCGATTCACCATCTCCAGAGACAATTCAAAGAACACGCT GTTTCTGCAAATGAACAGCCTGCGAGCCGAGGACACGGCTG TGTATTACTGTGCGAGAGATCGGCTCAATTACTATGATAGTA GTGGTTATTATCACTACAAATACGGTATGGCCGTCTGGG GCCAAGGGACAACAGTTACTGTCTCTAGT (SEQ ID NO: 570) |
| iPS:386754 | SEQ ID NO: 561 | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGGGGCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGAAAGTAGT GGTTATTATCACTACAAATACTACGGTATGGCCGTCTGGGGC CAAGGGACAACAGTTACTGTCTCTAGTGGAGGCGGAGGATC TGGTGGCGGTGGTTCTGGCGGCGGAGGCTCCCAGTCTGTGTT GACGCAGCCGCCCTCAGTGTCTGCGGCCCCAGGACAGAAGG TCACCATCTCCTGCTCTGGAAGCAGCTCCAACATTGGGAATA ATTATGTATCCTGGTACCAGCAGCTCCCAGGAACAGCCCCCA AACTCCTCATTTATGACAATAATAAGCGACCCTCAGGGATTC CTGACCGATTCTCTGGCTCCAAGTCTGGCACGTCAACCACCC TGGGCATCACCGGACTCCAGACTGGGGACGAGGCCGATTAT TACTGCGGAACATGGGATAGCCGCCTGAGTGCTGTGGTTTTC GGCGGAGGGACCAAGCTGACCGTGCTA (SEQ ID NO: 571) |
| iPS:386752 | SEQ ID NO: 561 | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGGGGCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGAAAGTAGTG GTTATTATCACTACAAATACTACGGTATGGCCGTCTGGGGCC AAGGGACAACAGTTACTGTCTCTAGTGGAGGCGGAGGATCT GGTGGCGGTGGTTCTGGCGGCGGAGGCTCCCAGTCTGTGTTG ACGCAGCCGCCCTCAGTGTCTGCGGCCCCAGGACAGAAGGT CACCATCTCCTGCTCTGGAAGCAGCTCCAACATTGGGAATAA |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
| --- | --- | --- |
| | | TTATGTATCCTGGTACCAGCAGCTCCCAGGAACAGCCCCCAA<br>ACTCCTCATTTATGACAATAATAAGCGACCCTCAGGGATTCC<br>TGACCGATTCTCTGGCTCCAAGTCTGGCACGTCAGCCACCCT<br>GGGCATCACCGGACTCCAGACTGGGGACGAGGCCGATTATT<br>ACTGCGGAACATGGGATAGCCGCCTGAGTGCTGTGGTTTTCG<br>GCGGAGGGACCAAGCTGACCGTGCTA<br>(SEQ ID NO: 572) |
| iPS:386750 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGGTGCAGCTGGTGGAATCTGGGGGAGGC<br>GTGGTCCAGCCTGGGAGGTCCCTGAGACTCTCCTGTGCAGCC<br>TCTGGATTCACCTTCAGTAGCTTTGGCATGCACTGGGTCCGC<br>CAGGCTCCAGGCAAGTGTCTGGAGTGGGTGGCAGTTATATC<br>ATTTGATGGAAGTATTAAGTATTCTGTAGACTCCGTGAAGGG<br>CCGATTCACCATCTCCAGAGACAATTCAAAGAACACGCTGTT<br>TCTGCAAATGAACAGCCTGCGAGCCGAGGACACGGCTGTGT<br>ATTACTGTGCGAGAGATCGGCTCAATTACTATGATAGTAGTG<br>GTTATTATCACTACAAATACTACGGTATGGCCGTCTGGGGCC<br>AAGGGACAACAGTTACTGTCTCTAGTGGAGGCGGAGGATCT<br>GGTGGCGGTGGTTCTGGCGGCGGAGGCTCCCAGTCTGTGTTG<br>ACGCAGCCGCCCTCAGTGTCTGCGGCCCAGGACAGAAGGT<br>CACCATCTCCTGCTCTGGAAGCAGCTCCAACATTGGGAATAA<br>TTATGTATCCTGGTACCAGCAGCTCCCAGGAACAGCCCCCAA<br>ACTCCTCATTTATGACAATAATAAGCGACCCTCAGGGATTCC<br>TGACCGATTCTCTGGCTCCAAGTCTGGCACGTCAGCCACCCT<br>GGGCATCACCGGACTCCAGACTGGGGACGAGGCCGATTATT<br>ACTGCGGAACATGGGATAGCCGCCTGAGTGCTGTGGTTTTCG<br>GCTGTGGGACCAAGCTGACCGTGCTA<br>(SEQ ID NO: 573) |
| iPS:386748 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
| --- | --- | --- |
| | | CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGGGGCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGAAAGTAGT GGTTATTATCACTACAAATACTACGGTATGGCCGTCTGGGGC CAAGGGACAACAGTTACTGTCTCTAGTGGAGGCGGAGGATC TGGTGGCGGTGGTTCTGGCGGCGGAGGCTCCCAGTCTGTGTT GACGCAGCCGCCCTCAGTGTCTGCGGCCCCAGGACAGAAGG TCACCATCTCCTGCTCTGGAAGCAGCTCCAACATTGGGAATA ATTATGTATCCTGGTACCAGCAGCTCCCAGGAACAGCCCCCA AACTCCTCATTTATGACAATAATAAGCGACCCTCAGGGATTC CTGACCGATTCTCTGGCTCCAAGTCTGGCACGTCAGCCACCC TGGGCATCACCGGACTCCAGACTGGGGACGAGGCCGATTAT TACTGCGGAACATGGGATAGCCGCCTGAGTGCTGTGGTTTTC GGCGGAGGGACCAAGCTGACCGTGCTA (SEQ ID NO: 574) |
| iPS:386746 | SEQ ID NO: 561 | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GCCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGGGGCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGATAGTAGTG GTTATTATCACTACAAATACTACGGTATGGCCGTCTGGGGCC AAGGGACAACAGTTACTGTCTCTAGTGGAGGCGGAGGATCT GGTGGCGGTGGTTCTGGCGGCGGAGGCTCCCAGTCTGTGTTG ACGCAGCCGCCCTCAGTGTCTGCGGCCCAGGACAGAAGGT CACCATCTCCTGCTCTGGAAGCAGCTCCAACATTGGGAATAA TTATGTATCCTGGTACCAGCAGCTCCCAGGAACAGCCCCCAA ACTCCTCATTTATGACAATAATAAGCGACCCTCAGGGATTCC TGACCGATTCTCTGGCTCCAAGTCTGGCACGTCAGCCACCCT GGCCATCACCGGACTCCAGACTGGGGACGAGGCCGATTATT ACTGCGGAACATGGGATAGCGCCTGAGTGCTGTGGTTTTCG GCGGAGGGACCAAGCTGACCGTGCTA (SEQ ID NO: 575) |
| iPS:386744 | SEQ ID NO: 561 | CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCTAGTGCCTCCACCAAG GGCCCATCGGTCTTCCCCCTGGCACCCTCCTCCAAGAGCACC TCTGGGGGCACAGCGGCCCTGGGCTGCCTGGTCAAGGACTA CTTCCCCGAACCGGTGACGGTGTCGTGGAACTCAGGCGCCCT GACCAGCGGCGTGCACACCTTCCCGGCTGTCCTACAGTCCTC AGGACTCTACTCCCTCAGCAGCGTGGTGACCGTGCCCTCCAG CAGCTTGGGCACCCAGACCTACATCTGCAACGTGAATCACA AGCCCAGCAACACCAAGGTGGACAAGAAAGTTGAGCCCAA ATCTTGTGACAAAACTCACACATGCCCACCGTGCCCAGCACC TGAACTCCTGGGGGGACCGTCAGTCTTCCTCTTCCCCCCAAA ACCCAAGGACACCCTCATGATCTCCCGGACCCCTGAGGTCA CATGCGTGGTGGTGGACGTGAGCCACGAAGACCCTGAGGTC AAGTTCAACTGGTACGTGGACGGCGTGGAGGTGCATAATGC CAAGACAAAGCCGTGTGAGGAGCAGTACGGCAGCACGTACC GTTGTGTCAGCGTCCTCACCGTCCTGCACCAGGACTGGCTGA ATGGCAAGGAGTACAAGTGCAAGGTCTCCAACAAAGCCCTC CCAGCCCCCATCGAGAAAACCATCTCCAAAGCCAAAGGGCA GCCCCGAGAACCACAGGTGTACACCCTGCCCCCATCCCGGG AGGAGATGACCAAGAACCAGGTCAGCCTGACCTGCCTGGTC AAAGGCTTCTATCCCAGCGACATCGCCGTGGAGTGGGAGAG CAATGGGCAGCCGGAGAACAACTACAAGACCACGCCTCCCG TGCTGGACTCCGACGGCTCCTTCTTCCTCTATAGCAAGCTCA CCGTGGACAAGAGCAGGTGGCAGCAGGGGAACGTCTTCTCA TGCTCCGTGATGCATGAGGCTCTGCACAACCACTACACGCA GAAGAGCCTAAGCTTGTCTCCGGGTGGTGGCGGATCGGGAG GTGGCGGATCCCAGGTGCAGCTGGTGGAATCTGGGGGAGGC GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGTGTCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGATAGTAGTG GTTATTATCACTACAAATACTACGGTATGGCCGTCTGGGGCC AAGGGACAACAGTTACTGTCTCTAGTGGAGGCGGAGGATCT GGTGGCGGTGGTTCTGGCGGCGGAGGCTCCCAGTCTGTGTTG ACGCAGCCGCCCTCAGTGTCTGCGGCCCAGGACAGAAGGT CACCATCTCCTGCTCTGGAAGCAGCTCCAACATTGGGAATAA TTATGTATCCTGGTACCAGCAGCTCCCAGGAACAGCCCCCAA ACTCCTCATTTATGACAATAATAAGCGACCCTCAGGGATTCC TGACCGATTCTCTGGCTCCAAGTCTGGCACGTCAGCCACCCT |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | GGCCATCACCGGACTCCAGACTGGGGACGAGGCCGATTATT<br>ACTGCGGAACATGGGATAGCCGCCTGAGTGCTGTGGTTTTCG<br>GCTGTGGGACCAAGCTGACCGTGCTA<br>(SEQ ID NO: 576) |
| iPS:386742 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGGTGCAGCTGGTGGAATCTGGGGGAGGC<br>GTGGTCCAGCCTGGGAGGTCCCTGAGACTCTCCTGTGCAGCC<br>TCTGGATTCACCTTCAGTAGCTTTGGCATGCACTGGGTCCGC<br>CAGGCTCCAGGCAAGTGTCTGGAGTGGGTGGCAGTTATATC<br>CCGATTCACCATCTCCAGAGACAATTCAAAGAACACGCTGTT<br>TCTGCAAATGAACAGCCTGCGAGCCGAGGACACGGCTGTGT<br>ATTACTGTGCGAGAGATCGGCTCAATTACTATGAAAGTAGT<br>GGTTATTATCACTACAAATACTACGGTATGGCCGTCTGGGGC<br>CAAGGGACAACAGTTACTGTCTCTAGTGGAGGCGGAGGATC<br>TGGTGGCGGTGGTTCTGGCGGCGGAGGCTCCCAGTCTGTGTT<br>GACGCAGCCGCCCTCAGTGTCTGCGGCCCCAGGACAGAAGG<br>TCACCATCTCCTGCTCTGGAAGCAGCTCCAACATTGGGAATA<br>ATTATGTATCCTGGTACCAGCAGCTCCCAGGAACAGCCCCCA<br>AACTCCTCATTTATGACAATAATAAGCGACCCTCAGGGATTC<br>CTGACCGATTCTCTGGCTCCAAGTCTGGCACGTCAGCCACCC<br>TGGGCATCACCGGACTCCAGACTGGGGACGAGGCCGATTAT<br>TACTGCGGAACATGGGATAGCCGCCTGAGTGCTGTGGTTTTC<br>GGCTGTGGGACCAAGCTGACCGTGCTA<br>(SEQ ID NO: 577) |
| iPS:386740 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGAG<br>GTGGCGGATCCCAGGTGCAGCTGGTGGAATCTGGGGGAGGC<br>GTGGTCCAGCCTGGGAGGTCCCTGAGACTCTCCTGTGCAGCC<br>TCTGGATTCACCTTCAGTAGCTTTGGCATGCACTGGGTCCGC<br>CAGGCTCCAGGCAAGTGTCTGGAGTGGGTGGCAGTTATATC<br>ATTTGATGGAAGTATTAAGTATTCTGTAGACTCCGTGAAGGG<br>CCGATTCACCATCTCCAGAGACAATTCAAAGAACACGCTGTT<br>TCTGCAAATGAACAGCCTGCGAGCCGAGGACACGGCTGTGT<br>ATTACTGTGCGAGAGATCGGCTCAATTACTATGAAAGTAGT<br>GGTTATTATCACTACAAATACTACGGTATGGCCGTCTGGGGC<br>CAAGGGACAACAGTTACTGTCTCTAGTGGAGGCGGAGGATC<br>TGGTGGCGGTGGTTCTGGCGGCGGAGGCTCCCAGTCTGTGTT<br>GACGCAGCCGCCCTCAGTGTCTGCGGCCCCAGGACAGAAGG<br>TCACCATCTCCTGCTCTGGAAGCAGCTCCAACATTGGGAATA<br>ATTATGTATCCTGGTACCAGCAGCTCCCAGGAACAGCCCCCA<br>AACTCCTCATTTATGACAATAATAAGCGACCCTCAGGGATTC<br>CTGACCGATTCTCTGGCTCCAAGTCTGGCACGTCAACCACCC<br>TGGGCATCACCGGACTCCAGACTGGGGACGAGGCCGATTAT<br>TACTGCGGAACATGGGATAGCCGCCTGAGTGCTGTGGTTTTC<br>GGCTGTGGGACCAAGCTGACCGTGCTA<br>(SEQ ID NO: 578) |
| iPS:386736 | SEQ ID NO: 561 | CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCTAGTGCCTCCACCAAG<br>GGCCCATCGGTCTTCCCCCTGGCACCCTCCTCCAAGAGCACC<br>TCTGGGGGCACAGCGGCCCTGGGCTGCCTGGTCAAGGACTA<br>CTTCCCCGAACCGGTGACGGTGTCGTGGAACTCAGGCGCCCT<br>GACCAGCGGCGTGCACACCTTCCCGGCTGTCCTACAGTCCTC<br>AGGACTCTACTCCCTCAGCAGCGTGGTGACCGTGCCCTCCAG<br>CAGCTTGGGCACCCAGACCTACATCTGCAACGTGAATCACA<br>AGCCCAGCAACACCAAGGTGGACAAGAAAGTTGAGCCCAA<br>ATCTTGTGACAAAACTCACACATGCCCACCGTGCCCAGCACC<br>TGAACTCCTGGGGGGACCGTCAGTCTTCCTCTTCCCCCCAAA<br>ACCCAAGGACACCCTCATGATCTCCCGGACCCCTGAGGTCA<br>CATGCGTGGTGGTGGACGTGAGCCACGAAGACCCTGAGGTC<br>AAGTTCAACTGGTACGTGGACGGCGTGGAGGTGCATAATGC<br>CAAGACAAAGCCGTGTGAGGAGCAGTACGGCAGCACGTACC<br>GTTGTGTCAGCGTCCTCACCGTCCTGCACCAGGACTGGCTGA<br>ATGGCAAGGAGTACAAGTGCAAGGTCTCCAACAAAGCCCTC<br>CCAGCCCCCATCGAGAAAACCATCTCCAAAGCCAAAGGGCA<br>GCCCCGAGAACCACAGGTGTACACCCTGCCCCCATCCCGGG<br>AGGAGATGACCAAGAACCAGGTCAGCCTGACCTGCCTGGTC<br>AAAGGCTTCTATCCCAGCGACATCGCCGTGGAGTGGGAGAG<br>CAATGGGCAGCCGGAGAACAACTACAAGACCACGCCTCCCG<br>TGCTGGACTCCGACGGCTCCTTCTTCCTCTATAGCAAGCTCA<br>CCGTGGACAAGAGCAGGTGGCAGCAGGGGAACGTCTTCTCA<br>TGCTCCGTGATGCATGAGGCTCTGCACAACCACTACACGCA<br>GAAGAGCCTAAGCTTGTCTCCGGGTGGTGGCGGATCGGGAG<br>GTGGCGGATCCCAGGTGCAGCTGGTGGAATCTGGGGGAGGC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | GTGGTCCAGCCTGGGAGGTCCCTGAGACTCTCCTGTGCAGCC TCTGGATTCACCTTCAGTAGCTTTGGCATGCACTGGGTCCGC CAGGCTCCAGGCAAGGGGCTGGAGTGGGTGGCAGTTATATC ATTTGATGGAAGTATTAAGTATTCTGTAGACTCCGTGAAGGG CCGATTCACCATCTCCAGAGACAATTCAAAGAACACGCTGTT TCTGCAAATGAACAGCCTGCGAGCCGAGGACACGGCTGTGT ATTACTGTGCGAGAGATCGGCTCAATTACTATGATAGTAGTG GTTATTATCACTACAAATACTACGGTATGGCCGTCTGGGGCC AAGGGACAACAGTTACTGTCTCTAGTGGAGGCGGAGGATCT GGTGGCGGTGGTTCTGGCGGCGGAGGCTCCCAGTCTGTGTTG ACGCAGCCGCCCTCAGTGTCTGCGGCCCCAGGACAGAAGGT CACCATCTCCTGCTCTGGAAGCAGCTCCAACATTGGGAATAA TTATGTATCCTGGTACCAGCAGCTCCCAGGAACAGCCCCCAA ACTCCTCATTTATGACAATAATAAGCGACCCTCAGGGATTCC TGACCGATTCTCTGGCTCCAAGTCTGGCACGTCAACCACCCT GGGCATCACCGGACTCCAGACTGGGGACGAGGCCGATTATT ACTGCGGAACATGGGATAGCGCCTGAGTGCTGTGGTTTTCG GCGGAGGGACCAAGCTGACCGTGCTA (SEQ ID NO: 579) |

Anti-CGRP Receptor IgG x Anti-PAC1 Receptor scFv

| iPS:386731 | CAGTCTGTGTTGAC GCAGCCGCCCTCAG TGTCTGCGGCCCCA GGACAGAAGGTCA CCATCTCCTGCTCT GGAAGCAGCTCCA ACATTGGGAATAAT TATGTATCCTGGTA CCAGCAGCTCCCAG GAACAGCCCCCAA ACTCCTCATTTATG ACAATAATAAGCG ACCCTCAGGGATTC CTGACCGATTCTCT GGCTCCAAGTCTGG CACGTCAACCACCC TGGGCATCACCGGA CTCCAGACTGGGGA CGAGGCCGATTATT ACTGCGGAACATG GGATAGCGCCTGA GTGCTGTGGTTTTC GGCGGAGGGACCA AGCTGACCGTCCTA GGTCAGCCCAAGG CCAACCCCACTGTC ACTCTGTTCCCGCC CTCCTCTGAGGAGC TCCAAGCCAACAA GGCCACACTAGTGT GTCTGATCAGTGAC TTCTACCCGGGAGC TGTGACAGTGGCCT GGAAGGCAGATGG CAGCCCCGTCAAGG CGGGAGTGGAGAC CACCAAACCCTCCA AACAGAGCAACAA CAAGTACGCGGCC AGCAGCTACCTGAG CCTGACGCCCGAGC AGTGGAAGTCCCAC AGAAGCTACAGCT GCCAGGTCACGCAT GAAGGGAGCACCG TGGAGAAGACAGT GGCCCCTACAGAAT GTTCA (SEQ ID NO: 562) | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGAAAGTAGTGGTTATTATCA CTACAAATACTACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC GATATCCAGCTCACTCAATCGCCATCATTTCTCTCCGCTTCG GTAGGCGACCGGGTCACGATCACATGCAGGGCGTCGCAAAG CATTGGGAGGTCGTTGCATTGGTATCAGCAGAAACCCGGAA AGGCCCCGAAACTTCTGATCAAATACGCATCACAAAGTTTG AGCGGTGTGCCGTCGCGCTTCTCCGGTTCCGGAAGCGGAAC GGAGTTCACGCTTACAATCTCCTCACTGCAGCCCGAGGATTT CGCGACCTATTACTGTCACCAGTCATCCAGACTCCCGTTTAC TTTTGGCCCTGGGACCAAGGTGGACATTAAGCGTGGAGGCG GAGGATCTGGTGGCGGTGGTTCTGGCGGCGGAGGCTCCCAA GTTCAGTTGGTGGAGTCTGGAGCCGAAGTAGTAAAGCCAGG AGCTTCAGTGAAAGTGTCTTGTAAAGCAAGTGGATTCACGTT TAGCCGCTTTGCCATGCATTGGGTGCGCCAAGCTCCCGGTCA GGGGTTGGAGTGGATGGGAGTTATTAGCTATGACGGGGGCA ATAAGTACTACGCCGAGTCTGTTAAGGGTCGGGTCACAATG ACACGGGACACCTCAACCAGTACACTCTATATGGAACTGTCT AGCCTGAGATCCGAGGACACCGCTGTGTATTATTGCGCTAG GGGGTACGATGTATTGACGGGTTATCCTGATTACTGGGGGC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
| --- | --- | --- |
| | | AGGGGACACTCGTAACCGTGTCTTCA<br>(SEQ ID NO: 580) |
| iPS:386725 | SEQ ID NO: 562 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGATAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA<br>CCCTCATGATCTCCCGGACCCCTGAGGTCACATGCGTGGTGG<br>TGGACGTGAGCCACGAAGACCCTGAGGTCAAGTTCAACTGG<br>TACGTGGACGGCGTGGAGGTGCATAATGCCAAGACAAAGCC<br>GTGTGAGGAGCAGTACGGCAGCACGTACCGTTGTGTCAGCG<br>TCCTCACCGTCCTGCACCAGGACTGGCTGAATGGCAAGGAG<br>TACAAGTGCAAGGTCTCCAACAAAGCCCTCCCAGCCCCCAT<br>CGAGAAAACCATCTCCAAAGCCAAAGGGCAGCCCCGAGAAC<br>CACAGGTGTACACCCTGCCCCCATCCCGGGAGGAGATGACC<br>AAGAACCAGGTCAGCCTGACCTGCCTGGTCAAAGGCTTCTA<br>TCCCAGCGACATCGCCGTGGAGTGGGAGAGCAATGGGCAGC<br>CGGAGAACAACTACAAGACCACGCCTCCCGTGCTGGACTCC<br>GACGGCTCCTTCTTCCTCTATAGCAAGCTCACCGTGGACAAG<br>AGCAGGTGGCAGCAGGGGAACGTCTTCTCATGCTCCGTGAT<br>GCATGAGGCTCTGCACAACCACTACACGCAGAAGAGCCTAA<br>GCTTGTCTCCGGGTGGTGGCGGATCGGGAGGTGGCGGATCC<br>GATATCCAGCTCACTCAATCGCCATCATTTCTCTCCGCTTCG<br>GTAGGCGACCGGGTCACGATCACATGCAGGGCGTCGCAAAG<br>CATTGGGAGGTCGTTGCATTGGTATCAGCAGAAACCCGGAA<br>AGGCCCCGAAACTTCTGATCAAATACGCATCACAAAGTTTG<br>AGCGGTGTGCCGTCGCGCTTCTCCGGTTCCGGAAGCGGAAC<br>GGAGTTCACGCTTACAATCTCCTCACTGCAGCCCGAGGATTT<br>CGCGACCTATTACTGTCACCAGTCATCCAGACTCCCGTTTAC<br>TTTTGGCCCTGGGACCAAGGTGGACATTAAGCGTGGAGGCG<br>GAGGATCTGGTGGCGGTGGTTCTGGCGGCGGAGGCTCCCAA<br>GTTCAGTTGGTGGAGTCTGGAGCCGAAGTAGTAAAGCCAGG<br>AGCTTCAGTGAAAGTCTCTTGTAAAGCAAGTGGATTCACGTT<br>TAGCCGCTTTGCCATGCATTGGGTGCGGCAAGCTCCCGGTCA<br>GGGGTTGGAGTGGATGGGAGTTATTAGCTATGACGGGGGCA<br>ATAAGTACTACGCCGAGTCTGTTAAGGGTCGGGTCACAATG<br>ACACGGGACACCTCAACCAGTACACTCTATATGGAACTGTCT<br>AGCCTGAGATCCGAGGACACCGCTGTGTATTATTGCGCTAG<br>GGGGTACGATGTATTGACGGGTTATCCTGATTACTGGGGGC<br>AGGGGACACTCGTAACCGTGTCTTCA<br>(SEQ ID NO: 581) |
| iPS:386717 | SEQ ID NO: 562 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGAAAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCCGGAAAGTGCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCT GTGGGACCAAGGTGGACATTAAGCGT (SEQ ID NO: 582) |
| iPS:386715 | SEQ ID NO: 562 | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGATAGTAGTGGTTATTATCA CTACAAATACACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCGGAAAGTGCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCT GTGGGACCAAGGTGGACATTAAGCGT (SEQ ID NO: 583) |
| iPS:386707 | SEQ ID NO: 562 | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGAAAGTAGTGGTTATTATCA CTACAAATACTACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCGGAAAGGCCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCC CTGGGACCAAGGTGGACATTAAGCGT (SEQ ID NO: 584) |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
| --- | --- | --- |
| iPS:386705 | SEQ ID NO: 562 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGATAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA<br>CCCTCATGATCTCCCGGACCCCTGAGGTCACATGCGTGGTGG<br>TGGACGTGAGCCACGAAGACCCTGAGGTCAAGTTCAACTGG<br>TACGTGGACGGCGTGGAGGTGCATAATGCCAAGACAAAGCC<br>GTGTGAGGAGCAGTACGGCAGCACGTACCGTTGTGTCAGCG<br>TCCTCACCGTCCTGCACCAGGACTGGCTGAATGGCAAGGAG<br>TACAAGTGCAAGGTCTCCAACAAAGCCCTCCCAGCCCCCAT<br>CGAGAAAACCATCTCCAAAGCCAAAGGGCAGCCCCGAGAAC<br>CACAGGTGTACACCCTGCCCCCATCCCGGGAGGAGATGACC<br>AAGAACCAGGTCAGCCTGACCTGCCTGGTCAAAGGCTTCTA<br>TCCCAGCGACATCGCCGTGGAGTGGGAGAGCAATGGGCAGC<br>CGGAGAACAACTACAAGACCACGCCTCCCGTGCTGGACTCC<br>GACGGCTCCTTCTTCCTCTATAGCAAGCTCACCGTGGACAAG<br>AGCAGGTGGCAGCAGGGGAACGTCTTCTCATGCTCCGTGAT<br>GCATGAGGCTCTGCACAACCACTACACGCAGAAGAGCCTAA<br>GCTTGTCTCCGGGTGGTGGCGGATCGGGAGGTGGCGGATCC<br>CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCCTCAGGAGGCGGAGGA<br>TCTGGTGGCGGTGGTTCTGGCGGCGGAGGCTCCGATATCCA<br>GCTCACTCAATCGCCATCATTTCTCTCCGCTTCGGTAGGCGA<br>CCGGGTCACGATCACATGCAGGGCGTCGCAAAGCATTGGGA<br>GGTCGTTGCATTGGTATCAGCAGAAACCCGGAAAGGCCCCG<br>AAACTTCTGATCAAATACGCATCACAAAGTTTGAGCGGTGT<br>GCCGTCGCGCTTCTCCGGTTCCGGAAGCGGAACGGAGTTCA<br>CGCTTACAATCTCCTCACTGCAGCCCGAGGATTTCGCGACCT<br>ATTACTGTCACCAGTCATCCAGACTCCCGTTTACTTTTGGCC<br>CTGGGACCAAGGTGGACATTAAGCGT<br>(SEQ ID NO: 585) |
| iPS:386723 | CAGTCTGTGTTGAC<br>GCAGCCGCCCTCAG<br>TGTCTGCGGCCCCA<br>GGACAGAAGGTCA<br>CCATCTCCTGCTCT<br>GGAAGCAGCTCCA<br>ACATTGGGAATAAT<br>TATGTATCCTGGTA<br>CCAGCAGCTCCCAG<br>GAACAGCCCCCAA<br>ACTCCTCATTTATG<br>ACAATAATAAGCG<br>ACCCTCAGGGATTC<br>CTGACCGATTCTCT<br>GGCTCCAAGTCTGG<br>CACGTCAGCCACCC<br>TGGGCATCACCGGA<br>CTCCAGACTGGGGA<br>CGAGGCCGATTATT | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGAAAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | ACTGCGGAACATG GGATAGCCGCCTGA GTGCTGTGGTTTTC GGCGGAGGGACCA AGCTGACCGTCCTA GGTCAGCCCAAGG CCAACCCCACTGTC ACTCTGTTCCCGCC CTCCTCTGAGGAGC TCCAAGCCAACAA GGCCACACTAGTGT GTCTGATCAGTGAC TTCTACCCGGGAGC TGTGACAGTGGCCT GGAAGGCAGATGG CAGCCCCGTCAAGG CGGGAGTGGAGAC CACCAAACCCTCCA AACAGAGCAACAA CAAGTACGCGGCC AGCAGCTACCTGAG CCTGACGCCCGAGC AGTGGAAGTCCCAC AGAAGCTACAGCT GCCAGGTCACGCAT GAAGGGAGCACCG TGGAGAAGACAGT GGCCCCTACAGAAT GTTCA (SEQ ID NO: 563) | CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCGGAAAGTGCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCT GTGGGACCAAGGTGGACATTAAGCGT (SEQ ID NO: 586) |
| iPS:386719 | SEQ ID NO: 563 | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGATAGTAGTGGTTATTATCA CTACAAATACTACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCCTCAGGAGGCGGAGGA<br>TCTGGTGGCGGTGGTTCTGGCGGCGGAGGCTCCGATATCCA<br>GCTCACTCAATCGCCATCATTTCTCTCCGCTTCGGTAGGCGA<br>CCGGGTCACGATCACATGCAGGGCGTCGCAAAGCATTGGGA<br>GGTCGTTGCATTGGTATCAGCAGAAACCCGGAAAGTGCCCG<br>AAACTTCTGATCAAATACGCATCACAAAGTTTGAGCGGTGT<br>GCCGTCGCGCTTCTCCGGTTCCGGAAGCGGAACGGAGTTCA<br>CGCTTACAATCTCCTCACTGCAGCCCGAGGATTTCGCGACCT<br>ATTACTGTCACCAGTCATCCAGACTCCCGTTTACTTTTGGCT<br>GTGGGACCAAGGTGGACATTAAGCGT<br>(SEQ ID NO: 587) |
| iPS:386713 | SEQ ID NO: 563 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGAAAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA<br>CCCTCATGATCTCCCGGACCCCTGAGGTCACATGCGTGGTGG<br>TGGACGTGAGCCACGAAGACCCTGAGGTCAAGTTCAACTGG<br>TACGTGGACGGCGTGGAGGTGCATAATGCCAAGACAAAGCC<br>GCGTGTGAGGAGCAGTACGGCAGCACGTACCGTTGTGTCAGCG<br>TCCTCACCGTCCTGCACCAGGACTGGCTGAATGGCAAGGAG<br>TACAAGTGCAAGGTCTCCAACAAAGCCCTCCCAGCCCCCAT<br>CGAGAAAACCATCTCCAAAGCCAAAGGGCAGCCCCGAGAAC<br>CACAGGTGTACACCCTGCCCCCATCCCGGGAGGAGATGACC<br>AAGAACCAGGTCAGCCTGACCTGCCTGGTCAAAGGCTTCTA<br>TCCCAGCGACATCGCCGTGGAGTGGGAGAGCAATGGGCAGC<br>CGGAGAACAACTACAAGACCACGCCTCCCGTGCTGGACTCC<br>GACGGCTCCTTCTTCCTCTATAGCAAGCTCACCGTGGACAAG<br>AGCAGGTGGCAGCAGGGGAACGTCTTCTCATGCTCCGTGAT<br>GCATGAGGCTCTGCACAACCACTACACGCAGAAGAGCCTAA<br>GCTTGTCTCCGGGTGGTGGCGGATCGGGAGGTGGCGGATCC<br>CAAGTTCAGTTGGTGGAGTCTGGAGCCGAAGTAGTAAAGCC<br>AGGAGCTTCAGTGAAAGTCTCTTGTAAAGCAAGTGGATTCA<br>CGTTTAGCCGCTTTGCCATGCATTGGGTGCGGCAAGCTCCCG<br>GTCAGGGGTTGGAGTGGATGGGAGTTATTAGCTATGACGGG<br>GGCAATAAGTACTACGCCGAGTCTGTTAAGGGTCGGGTCAC<br>AATGACACGGGACACCTCAACCAGTACACTCTATATGGAAC<br>TGTCTAGCCTGAGATCCGAGGACACCGCTGTGTATTATTGCG<br>CTAGGGGGTACGATGTATTGACGGGTTATCCTGATTACTGGG<br>GGCAGGGGACACTCGTAACCGTCTCCTCAGGAGGCGGAGGA<br>TCTGGTGGCGGTGGTTCTGGCGGCGGAGGCTCCGATATCCA<br>GCTCACTCAATCGCCATCATTTCTCTCCGCTTCGGTAGGCGA<br>CCGGGTCACGATCACATGCAGGGCGTCGCAAAGCATTGGGA<br>GGTCGTTGCATTGGTATCAGCAGAAACCCGGAAAGGCCCCG<br>AAACTTCTGATCAAATACGCATCACAAAGTTTGAGCGGTGT<br>GCCGTCGCGCTTCTCCGGTTCCGGAAGCGGAACGGAGTTCA<br>CGCTTACAATCTCCTCACTGCAGCCCGAGGATTTCGCGACCT<br>ATTACTGTCACCAGTCATCCAGACTCCCGTTTACTTTTGGCC<br>CTGGGACCAAGGTGGACATTAAGCGT<br>(SEQ ID NO: 588) |
| iPS:386709 | SEQ ID NO: 563 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | CAAGGGGCTGGAGTGGGTGGCAGTTATATCATTTGATGGAA
GTATTAAGTATTCTGTAGACTCCGTGAAGGGCCGATTCACCA
TCTCCAGAGACAATTCAAAGAACACGCTGTTTCTGCAAATG
AACAGCCTGCGAGCCGAGGACACGGCTGTGTATTACTGTGC
GAGAGATCGGCTCAATTACTATGATAGTAGTGGTTATTATCA
CTACAAATACTACGGTATGGCCGTCTGGGGCCAAGGGACAA
CAGTTACCGTCTCTAGTGCCTCCACCAAGGGCCCATCGGTCT
TCCCCCTGGCACCCTCCTCCAAGAGCACCTCTGGGGGCACAG
CGGCCCTGGGCTGCCTGGTCAAGGACTACTTCCCCGAACCG
GTGACGGTGTCGTGGAACTCAGGCGCCCTGACCAGCGGCGT
GCACACCTTCCCGGCTGTCCTACAGTCCTCAGGACTCTACTC
CCTCAGCAGCGTGGTGACCGTGCCCTCCAGCAGCTTGGGCA
CCCAGACCTACATCTGCAACGTGAATCACAAGCCCAGCAAC
ACCAAGGTGGACAAGAAAGTTGAGCCCAAATCTTGTGACAA
AACTCACACATGCCCACCGTGCCCAGCACCTGAACTCCTGG
GGGGACCGTCAGTCTTCCTCTTCCCCCCAAAACCCAAGGACA
CCCTCATGATCTCCCGGACCCCTGAGGTCACATGCGTGGTGG
TGGACGTGAGCCACGAAGACCCTGAGGTCAAGTTCAACTGG
TACGTGGACGGCGTGGAGGTGCATAATGCCAAGACAAAGCC
GTGTGAGGAGCAGTACGGCAGCACGTACCGTTGTGTCAGCG
TCCTCACCGTCCTGCACCAGGACTGGCTGAATGGCAAGGAG
TACAAGTGCAAGGTCTCCAACAAAGCCCTCCCAGCCCCCAT
CGAGAAAACCATCTCCAAAGCCAAAGGGCAGCCCCGAGAAC
CACAGGTGTACACCCTGCCCCCATCCCGGGAGGAGATGACC
AAGAACCAGGTCAGCCTGACCTGCCTGGTCAAAGGCTTCTA
TCCCAGCGACATCGCCGTGGAGTGGGAGAGCAATGGGCAGC
CGGAGAACAACTACAAGACCACGCCTCCCGTGCTGGACTCC
GACGGCTCCTTCTTCCTCTATAGCAAGCTCACCGTGGACAAG
AGCAGGTGGCAGCAGGGGAACGTCTTCTCATGCTCCGTGAT
GCATGAGGCTCTGCACAACCACTACACGCAGAAGAGCCTAA
GCTTGTCTCCGGGTGGTGGCGGATCGGGAGGTGGCGGATCC
CAAGTTCAGTTGGTGGAGTCTGGAGCCGAAGTAGTAAAGCC
AGGAGCTTCAGTGAAAGTCTCTTGTAAAGCAAGTGGATTCA
CGTTTAGCCGCTTTGCCATGCATTGGGTGCGGCAAGCTCCCG
GTCAGGGGTTGGAGTGGATGGGAGTTATTAGCTATGACGGG
GGCAATAAGTACTACGCCGAGTCTGTTAAGGGTCGGGTCAC
AATGACACGGGACACCTCAACCAGTACACTCTATATGGAAC
TGTCTAGCCTGAGATCCGAGGACACCGCTGTGTATTATTGCG
CTAGGGGGTACGATGTATTGACGGGTTATCCTGATTACTGGG
GGCAGGGGACACTCGTAACCGTCTCCTCAGGAGGCGGAGGA
TCTGGTGGCGGTGGTTCTGGCGGCGGAGGCTCCGATATCCA
GCTCACTCAATCGCCATCATTTCTCTCCGCTTCGGTAGGCGA
CCGGGTCACGATCACATGCAGGGCGTCGCAAAGCATTGGGA
GGTCGTTGCATTGGTATCAGCAGAAACCCGGAAAGGCCCCG
AAACTTCTGATCAAATACGCATCACAAAGTTTGAGCGGTGT
GCCGTCGCGCTTCTCCGGTTCCGGAAGCGGAACGGAGTTCA
CGCTTACAATCTCCTCACTGCAGCCCGAGGATTTCGCGACCT
ATTACTGTCACCAGTCATCCAGACTCCCGTTTACTTTTGGCC
CTGGGACCAAGGTGGACATTAAGCGT
(SEQ ID NO: 589) |
| iPS:386727 | SEQ ID NO: 563 | CAGGTGCAGCTGGTGGAATCTGGGGGAGGCGTGGTCCAGCC
TGGGAGGTCCCTGAGACTCTCCTGTGCAGCCTCTGGATTCAC
CTTCAGTAGCTTTGGCATGCACTGGGTCCGCCAGGCTCCAGG
CAAGGGGCTGGAGTGGGTGGCAGTTATATCATTTGATGGAA
GTATTAAGTATTCTGTAGACTCCGTGAAGGGCCGATTCACCA
TCTCCAGAGACAATTCAAAGAACACGCTGTTTCTGCAAATG
AACAGCCTGCGAGCCGAGGACACGGCTGTGTATTACTGTGC
GAGAGATCGGCTCAATTACTATGATAGTAGTGGTTATTATCA
CTACAAATACTACGGTATGGCCGTCTGGGGCCAAGGGACAA
CAGTTACCGTCTCTAGTGCCTCCACCAAGGGCCCATCGGTCT
TCCCCCTGGCACCCTCCTCCAAGAGCACCTCTGGGGGCACAG
CGGCCCTGGGCTGCCTGGTCAAGGACTACTTCCCCGAACCG
GTGACGGTGTCGTGGAACTCAGGCGCCCTGACCAGCGGCGT
GCACACCTTCCCGGCTGTCCTACAGTCCTCAGGACTCTACTC
CCTCAGCAGCGTGGTGACCGTGCCCTCCAGCAGCTTGGGCA
CCCAGACCTACATCTGCAACGTGAATCACAAGCCCAGCAAC
ACCAAGGTGGACAAGAAAGTTGAGCCCAAATCTTGTGACAA
AACTCACACATGCCCACCGTGCCCAGCACCTGAACTCCTGG
GGGGACCGTCAGTCTTCCTCTTCCCCCCAAAACCCAAGGACA
CCCTCATGATCTCCCGGACCCCTGAGGTCACATGCGTGGTGG
TGGACGTGAGCCACGAAGACCCTGAGGTCAAGTTCAACTGG
TACGTGGACGGCGTGGAGGTGCATAATGCCAAGACAAAGCC |

TABLE 13-continued

Nucleic Acid Sequences of Exemplary Bispecific Antigen Binding
Proteins in the IgG-scFv Format

| IgG-scFv Molecule Designation | Light Chain Nucleic Acid Sequence | Modified Heavy Chain Nucleic Acid Sequence |
|---|---|---|
| | | GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC GATATCCAGCTCACTCAATCGCCATCATTTCTCTCCGCTTCG GTAGGCGACCGGGTCACGATCACATGCAGGGCGTCGCAAAG CATTGGGAGGTCGTTGCATTGGTATCAGCAGAAACCCGGAA AGGCCCCGAAACTTCTGATCAAATACGCATCACAAAGTTTG AGCGGTGTGCCGTCGCGCTTCTCCGGTTCCGGAAGCGGAAC GGAGTTCACGCTTACAATCTCCTCACTGCAGCCCGAGGATTT CGCGACCTATTACTGTCACCAGTCATCCAGACTCCCGTTTAC TTTTGGCCCTGGGACCAAGGTGGACATTAAGCGTGGAGGCG GAGGATCTGGTGGCGGTGGTTCTGGCGGCGGAGGCTCCCAA GTTCAGTTGGTGGAGTCTGGAGCCGAAGTAGTAAAGCCAGG AGCTTCAGTGAAAGTCTCTTGTAAAGCAAGTGGATTCACGTT TAGCCGCTTTGCCATGCATTGGGTGCGGCAAGCTCCCGGTCA GGGGTTGGAGTGGATGGGAGTTATTAGCTATGACGGGGCA ATAAGTACTACGCCGAGTCTGTTAAGGGTCGGGTCACAATG ACACGGGACACCTCAACCAGTACACTCTATATGGAACTGTCT AGCCTGAGATCCGAGGACACCGCTGTGTATTATTGCGCTAG GGGGTACGATGTATTGACGGGTTATCCTGATTACTGGGGC AGGGGACACTCGTAACCGTGTCTTCA (SEQ ID NO: 590) |
| iPS:386721 | CAGTCTGTGTTGAC GCAGCCGCCCTCAG TGTCTGCGGCCCA GGACAGAAGGTCA CCATCTCCTGCTCT GGAAGCAGCTCCA ACATTGGGAATAAT TATGTATCCTGGTA CCAGCAGCTCCCAG GAACAGCCCCCAA ACTCCTCATTTATG ACAATAATAAGCG ACCCTCAGGGATTC CTGACCGATTCTCT GGCTCCAAGTCTGG CACGTCAGCCACCC TGGCCATCACCGGA CTCCAGACTGGGGA CGAGGCCGATTATT ACTGCGGAACATG GGATAGCCGCCTGA GTGCTGTGGTTTTC GGCGGAGGGACCA AGCTGACCGTCCTA GGTCAGCCCAAGG CCAACCCCACTGTC ACTCTGTTCCCGCC CTCCTCTGAGGAGC TCCAAGCCAACAA GGCCACACTAGTGT GTCTGATCAGTGAC TTCTACCCGGGAGC TGTGACAGTGGCCT GGAAGGCAGATGG CAGCCCCGTCAAGG CGGGAGTGGAGAC CACCAAACCCTCCA AACAGAGCAACAA CAAGTACGCGGCC AGCAGCTACCTGAG CCTGACGCCCGAGC | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGATAGTAGTGGTTATTATCA CTACAAATACTACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | AGTGGAAGTCCCAC AGAAGCTACAGCT GCCAGGTCACGCAT GAAGGGAGCACCG TGGAGAAGACAGT GGCCCCTACAGAAT GTTCA (SEQ ID NO: 564) | CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCCGGAAAGTGCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCT GTGGGACCAAGGTGGACATTAAGCGT (SEQ ID NO: 591) |
| iPS:386711 | SEQ ID NO: 564 | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG AACAGCCTGCGAGCCGAGGACACGGCTGTGTATTACTGTGC GAGAGATCGGCTCAATTACTATGATAGTAGTGGTTATTATCA CTACAAATACGGTATGGCCGTCTGGGGCCAAGGGACAA CAGTTACCGTCTCTAGTGCCTCCACCAAGGGCCCATCGGTCT TCCCCCTGGCACCCTCCTCCAAGAGCACCTCTGGGGGCACAG CGGCCCTGGGCTGCCTGGTCAAGGACTACTTCCCCGAACCG GTGACGGTGTCGTGGAACTCAGGCGCCCTGACCAGCGGCGT GCACACCTTCCCGGCTGTCCTACAGTCCTCAGGACTCTACTC CCTCAGCAGCGTGGTGACCGTGCCCTCCAGCAGCTTGGGCA CCCAGACCTACATCTGCAACGTGAATCACAAGCCCAGCAAC ACCAAGGTGGACAAGAAAGTTGAGCCCAAATCTTGTGACAA AACTCACACATGCCCACCGTGCCCAGCACCTGAACTCCTGG GGGGACCGTCAGTCTTCCTCTTCCCCCCAAAACCCAAGGACA CCCTCATGATCTCCCGGACCCCTGAGGTCACATGCGTGGTGG TGGACGTGAGCCACGAAGACCCTGAGGTCAAGTTCAACTGG TACGTGGACGGCGTGGAGGTGCATAATGCCAAGACAAAGCC GTGTGAGGAGCAGTACGGCAGCACGTACCGTTGTGTCAGCG TCCTCACCGTCCTGCACCAGGACTGGCTGAATGGCAAGGAG TACAAGTGCAAGGTCTCCAACAAAGCCCTCCCAGCCCCCAT CGAGAAAACCATCTCCAAAGCCAAAGGGCAGCCCCGAGAAC CACAGGTGTACACCCTGCCCCCATCCCGGGAGGAGATGACC AAGAACCAGGTCAGCCTGACCTGCCTGGTCAAAGGCTTCTA TCCCAGCGACATCGCCGTGGAGTGGGAGAGCAATGGGCAGC CGGAGAACAACTACAAGACCACGCCTCCCGTGCTGGACTCC GACGGCTCCTTCTTCCTCTATAGCAAGCTCACCGTGGACAAG AGCAGGTGGCAGCAGGGGAACGTCTTCTCATGCTCCGTGAT GCATGAGGCTCTGCACAACCACTACACGCAGAAGAGCCTAA GCTTGTCTCCGGGTGGTGGCGGATCGGGAGGTGGCGGATCC CAAGTTCAGTTGGTGGAGTCTGGAGCCGAAGTAGTAAAGCC AGGAGCTTCAGTGAAAGTCTCTTGTAAAGCAAGTGGATTCA CGTTTAGCCGCTTTGCCATGCATTGGGTGCGGCAAGCTCCCG GTCAGGGGTTGGAGTGGATGGGAGTTATTAGCTATGACGGG GGCAATAAGTACTACGCCGAGTCTGTTAAGGGTCGGGTCAC AATGACACGGGACACCTCAACCAGTACACTCTATATGGAAC TGTCTAGCCTGAGATCCGAGGACACCGCTGTGTATTATTGCG CTAGGGGGTACGATGTATTGACGGGTTATCCTGATTACTGGG GGCAGGGGACACTCGTAACCGTCTCCTCAGGAGGCGGAGGA TCTGGTGGCGGTGGTTCTGGCGGCGGAGGCTCCGATATCCA GCTCACTCAATCGCCATCATTTCTCTCCGCTTCGGTAGGCGA CCGGGTCACGATCACATGCAGGGCGTCGCAAAGCATTGGGA GGTCGTTGCATTGGTATCAGCAGAAACCCGGAAAGGCCCCG AAACTTCTGATCAAATACGCATCACAAAGTTTGAGCGGTGT GCCGTCGCGCTTCTCCGGTTCCGGAAGCGGAACGGAGTTCA CGCTTACAATCTCCTCACTGCAGCCCGAGGATTTCGCGACCT ATTACTGTCACCAGTCATCCAGACTCCCGTTTACTTTTGGCC CTGGGACCAAGGTGGACATTAAGCGT (SEQ ID NO: 592) |
| iPS:386733 | SEQ ID NO: 564 | CAGGTGCAGCTGGTGGAATCTGGGGGAGGCGTGGTCCAGCC TGGGAGGTCCCTGAGACTCTCCTGTGCAGCCTCTGGATTCAC CTTCAGTAGCTTTGGCATGCACTGGGTCCGCCAGGCTCCAGG CAAGGGGCTGGAGTGGGTGGCAGTTATATCATTTGATGGAA GTATTAAGTATTCTGTAGACTCCGTGAAGGGCCGATTCACCA TCTCCAGAGACAATTCAAAGAACACGCTGTTTCTGCAAATG |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | AACAGCCTGCGAGCCGAGGACACGGCTGTGTATTACTGTGC<br>GAGAGATCGGCTCAATTACTATGAAAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA<br>CCCTCATGATCTCCCGGACCCCTGAGGTCACATGCGTGGTGG<br>TGGACGTGAGCCACGAAGACCCTGAGGTCAAGTTCAACTGG<br>TACGTGGACGGCGTGGAGGTGCATAATGCCAAGACAAAGCC<br>GTGTGAGGAGCAGTACGGCAGCACGTACCGTTGTGTCAGCG<br>TCCTCACCGTCCTGCACCAGGACTGGCTGAATGGCAAGGAG<br>TACAAGTGCAAGGTCTCCAACAAAGCCCTCCCAGCCCCCAT<br>CGAGAAAACCATCTCCAAAGCCAAAGGGCAGCCCCGAGAAC<br>CACAGGTGTACACCCTGCCCCCATCCCGGGAGGAGATGACC<br>AAGAACCAGGTCAGCCTGACCTGCCTGGTCAAAGGCTTCTA<br>TCCCAGCGACATCGCCGTGGAGTGGGAGAGCAATGGGCAGC<br>CGGAGAACAACTACAAGACCACGCCTCCCGTGCTGGACTCC<br>GACGGCTCCTTCTTCCTCTATAGCAAGCTCACCGTGGACAAG<br>AGCAGGTGGCAGCAGGGGAACGTCTTCTCATGCTCCGTGAT<br>GCATGAGGCTCTGCACAACCACTACACGCAGAAGAGCCTAA<br>GCTTGTCTCCGGGTGGTGGCGGATCGGGAGGTGGCGGATCC<br>GATATCCAGCTCACTCAATCGCCATCATTTCTCTCCGCTTCG<br>GTAGGCGACCGGGTCACGATCACATGCAGGGCGTCGCAAAG<br>CATTGGGAGGTCGTTGCATTGGTATCAGCAGAAACCCGGAA<br>AGGCCCCGAAACTTCTGATCAAATACGCATCACAAAGTTTG<br>AGCGGTGTGCCGTCGCGCTTCTCCGGTTCCGGAAGCGGAAC<br>GGAGTTCACGCTTACAATCTCCTCACTGCAGCCCGAGGATTT<br>CGCGACCTATTACTGTCACCAGTCATCCAGACTCCCGTTTAC<br>TTTTGGCCCTGGGACCAAGGTGGACATTAAGCGTGGAGGCG<br>GAGGATCTGGTGGCGGTGGTTCTGGCGGCGGAGGCTCCCAA<br>GTTCAGTTGGTGGAGTCTGGAGCCGAAGTAGTAAAGCCAGG<br>AGCTTCAGTGAAAGTCTCTTGTAAAGCAAGTGGATTCACGTT<br>TAGCCGCTTTGCCATGCATTGGGTGCGGCAAGCTCCCGGTCA<br>GGGGTTGGAGTGGATGGGAGTTATTAGCTATGACGGGGGCA<br>ATAAGTACTACGCCGAGTCTGTTAAGGGTCGGGTCACAATG<br>ACACGGGACACCTCAACCAGTACACTCTATATGGAACTGTCT<br>AGCCTGAGATCCGAGGACACCGCTGTGTATTATTGCGCTAG<br>GGGGTACGATGTATTGACGGGTTATCCTGATTACTGGGGGC<br>AGGGGACACTCGTAACCGTGTCTTCA<br>(SEQ ID NO: 593) |
| iPS:386729 | SEQ ID NO: 564 | CAGGTGCAGCTGGTGGAATCTGGGGGAGGCGTGGTCCAGCC<br>TGGGAGGTCCCTGAGACTCTCCTGTGCAGCCTCTGGATTCAC<br>CTTCAGTAGCTTTGGCATGCACTGGGTCCGCCAGGCTCCAGG<br>CAAGGGGCTGGAGTGGGTGGCAGTTATATCATTTGATGGAA<br>GTATTAAGTATTCTGTAGACTCCGTGAAGGGCCGATTCACCA<br>TCTCCAGAGACAATTCAAAGAACACGCTGTTTCTGCAAATG<br>AACAGCCTGCGAGCCGAGGACACGGCTGTGTATTACTGTGC<br>GAGAGATCGGCTCAATTACTATGATAGTAGTGGTTATTATCA<br>CTACAAATACTACGGTATGGCCGTCTGGGGCCAAGGGACAA<br>CAGTTACCGTCTCTAGTGCCTCCACCAAGGGCCCATCGGTCT<br>TCCCCCTGGCACCCTCCTCCAAGAGCACCTCTGGGGGCACAG<br>CGGCCCTGGGCTGCCTGGTCAAGGACTACTTCCCCGAACCG<br>GTGACGGTGTCGTGGAACTCAGGCGCCCTGACCAGCGGCGT<br>GCACACCTTCCCGGCTGTCCTACAGTCCTCAGGACTCTACTC<br>CCTCAGCAGCGTGGTGACCGTGCCCTCCAGCAGCTTGGGCA<br>CCCAGACCTACATCTGCAACGTGAATCACAAGCCCAGCAAC<br>ACCAAGGTGGACAAGAAAGTTGAGCCCAAATCTTGTGACAA<br>AACTCACACATGCCCACCGTGCCCAGCACCTGAACTCCTGG<br>GGGGACCGTCAGTCTTCCTCTTCCCCCCAAAACCCAAGGACA<br>CCCTCATGATCTCCCGGACCCCTGAGGTCACATGCGTGGTGG<br>TGGACGTGAGCCACGAAGACCCTGAGGTCAAGTTCAACTGG<br>TACGTGGACGGCGTGGAGGTGCATAATGCCAAGACAAAGCC<br>GTGTGAGGAGCAGTACGGCAGCACGTACCGTTGTGTCAGCG<br>TCCTCACCGTCCTGCACCAGGACTGGCTGAATGGCAAGGAG<br>TACAAGTGCAAGGTCTCCAACAAAGCCCTCCCAGCCCCCAT |

TABLE 13-continued

Nucleic Acid Sequences of Exemplary Bispecific Antigen Binding Proteins in the IgG-scFv Format

| IgG-scFv Molecule Designation | Light Chain Nucleic Acid Sequence | Modified Heavy Chain Nucleic Acid Sequence |
|---|---|---|
| | | CGAGAAAACCATCTCCAAAGCCAAAGGGCAGCCCCGAGAAC<br>CACAGGTGTACACCCTGCCCCCATCCCGGGAGGAGATGACC<br>AAGAACCAGGTCAGCCTGACCTGCCTGGTCAAAGGCTTCTA<br>TCCCAGCGACATCGCCGTGGAGTGGGAGAGCAATGGGCAGC<br>CGGAGAACAACTACAAGACCACGCCTCCCGTGCTGGACTCC<br>GACGGCTCCTTCTTCCTCTATAGCAAGCTCACCGTGGACAAG<br>AGCAGGTGGCAGCAGGGGAACGTCTTCTCATGCTCCGTGAT<br>GCATGAGGCTCTGCACAACCACTACACGCAGAAGAGCCTAA<br>GCTTGTCTCCGGGTGGTGGCGGATCGGGAGGTGGCGGATCC<br>GATATCCAGCTCACTCAATCGCCATCATTTCTCTCCGCTTCG<br>GTAGGCGACCGGGTCACGATCACATGCAGGGCGTCGCAAAG<br>CATTGGGAGGTCGTTGCATTGGTATCAGCAGAAACCCGGAA<br>AGGCCCCGAAACTTCTGATCAAATACGCATCACAAAGTTTG<br>AGCGGTGTGCCGTCGCGCTTCTCCGGTTCCGGAAGCGGAAC<br>GGAGTTCACGCTTACAATCTCCTCACTGCAGCCCGAGGATTT<br>CGCGACCTATTACTGTCACCAGTCATCCAGACTCCCGTTTAC<br>TTTTGGCCCTGGGACCAAGGTGGACATTAAGCGTGGAGGCG<br>GAGGATCTGGTGGCGGTGGTTCTGGCGGCGGAGGCTCCCAA<br>GTTCAGTTGGTGGAGTCTGGAGCCGAAGTAGTAAAGCCAGG<br>AGCTTCAGTGAAAGTCTCTTGTAAAGCAAGTGGATTCACGTT<br>TAGCCGCTTTGCCATGCATTGGGTGCGGCAAGCTCCCGGTCA<br>GGGGTTGGAGTGGATGGGAGTTATTAGCTATGACGGGGGCA<br>ATAAGTACTACGCCGAGTCTGTTAAGGGTCGGGTCACAATG<br>ACACGGGACACCTCAACCAGTACACTCTATATGGAACTGTCT<br>AGCCTGAGATCCGAGGACACCGCTGTGTATTATTGCGCTAG<br>GGGGTACGATGTATTGACGGGTTATCCTGATTACTGGGGGC<br>AGGGGACACTCGTAACCGTGTCTTCA<br>(SEQ ID NO: 594) |

Nucleic acid sequences encoding the three components (e.g., light chains, modified heavy chains, and second polypeptides comprising the other half of the carboxyl-terminal Fab domains) of exemplary bispecific antigen binding proteins of the invention in the IgG-Fab format are listed in Table 14. In such embodiments, the isolated nucleic acid encoding the light chain of the IgG-Fab molecules may comprise a nucleotide sequence that is at least 80% identical, at least 90% identical, at least 95% identical, or at least 98% identical to any of the light chain nucleotide sequences listed in Table 14. For instance, in some embodiments, the isolated nucleic acid encoding the light chain of the IgG-Fab molecules comprises a sequence selected from SEQ ID NOs: 225, 287, 595, and 596. In related embodiments, the isolated nucleic acid encoding the modified heavy chain of the IgG-Fab molecules may comprise a nucleotide sequence that is at least 80% identical, at least 90% identical, at least 95% identical, or at least 98% identical to any of the modified heavy chain nucleotide sequences listed in Table 14. In certain embodiments, the isolated nucleic acid encoding the modified heavy chain of the IgG-Fab molecules comprises a sequence selected from SEQ ID NOs: 597 to 620. In these and other embodiments, the isolated nucleic acid encoding the second polypeptide of the IgG-Fab molecules, which comprises the other half of the carboxyl-terminal Fab domain (e.g. a Fd fragment or second light chain), may comprise a nucleotide sequence that is at least 80% identical, at least 90% identical, at least 95% identical, or at least 98% identical to any of the second polypeptide nucleotide sequences listed in Table 14. In some embodiments, the isolated nucleic acid encoding the second polypeptide of the IgG-Fab molecules comprises a sequence selected from SEQ ID NOs: 621 to 632.

TABLE 14

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| Anti-PAC1 Receptor IgG x Anti-CGRP Receptor Fab | | | |
| iPS:392513 | GATATCCAG<br>CTCACTCAA<br>TCGCCATCA<br>TTTCTCTCCG<br>CTTCGGTAG<br>GCGACCGGG<br>TCACGATCA<br>CATGCAGGG | CAAGTTCAGTTGGTGGAGTCTGGAGCCGAAGTAG<br>TAAAGCCAGGAGCTTCAGTGAAAGTCTCTTGTAA<br>AGCAAGTGGATTCACGTTTAGCCGCTTTGCCATGC<br>ATTGGGTGCGGCAAGCTCCCGGTCAGGGGTTGGA<br>GTGGATGGGAGTTATTAGCTATGACGGGGGCAAT<br>AAGTACTACGCCGAGTCTGTTAAGGGTCGGGTCA<br>CAATGACACGGGACACCTCAACCAGTACACTCTA<br>TATGGAACTGTCTAGCCTGAGATCCGAGGACACC | CAGGTGCAGCTG<br>GTGGAATCTGGG<br>GGAGGCGTGGTC<br>CAGCCTGGGAGG<br>TCCCTGAGACTCT<br>CCTGTGCAGCCTC<br>TGGATTCACCTTC<br>AGTAGCTTTGGC |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | CGTCGCAAA GCATTGGGA GGTCGTTGC ATTGGTATC AGCAGAAAC CCGGAAAGG CCCCGAAAC TTCTGATCA AATACGCAT CACAAAGCT TGAGCGGTG TGCCGTCGC GCTTCTCCG GTTCCGGAA GCGGAACGG AATTCACGC TTACAATCT CCTCACTGC AGCCCGAGG ATTTCGCGA CCTATTACT GTCACCAGT CATCCAGAC TCCCGTTTAC TTTTGGCCCT GGGACCAAG GTGGACATT AAGCGTACG GTGGCTGCA CCATCTGTCT TCATCTTCCC GCCATCTGA TGAGCAGTT GAAATCTGG AACTGCCTC TGTTGTGTG CCTGCTGAA TAACTTCTAT CCCAGAGAG GCCAAAGTA CAGTGGAAG GTGGATAAC GCCCTCCAA TCGGGTAAC TCCCAGGAG AGTGTCACA GAGCAGGAC AGCAAGGAC AGCACCTAC AGCCTCGAG AGCACCCTG ACGCTGAGC AAAGCAGAC TACGAGAAA CACAAAGTC TACGCCTGC GAAGTCACC CATCAGGGC CTGAGCTCG CCCGTCACA AAGAGCTTC AACAGGGGA GAGTGT (SEQ ID NO: 225) | GCTGTGTATTATTGCGCTAGGGGGTACGATGTATT GACGGGTTATCCTGATTACTGGGGGCAGGGGACA CTCGTAACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT GTGTCTGATCAGT AAGCTTGTCTCCGGGTGGTGGCGGATCGGGAGGT GACTTCTACCCGG GGCGGATCCCAGTCTGTGTTGACGCAGCCGCCCT GAGCTGTGACAG CAGTGTCTGCGGCCCAGGACGAAGGTCACCAT TGGCCTGGAAGG CTCCTGCTCTGGAAGCAGCTCCAACATTGGGAAT CAGATGGCAGCC AATTATGTATCCTGGTACCAGCAGCTCCCAGGAA CCGTCAAGGCGG CAGCCCCCAAACTCCTCATTTATGACAATAATAA GAGTGGAGACCA GCGACCCTCAGGGATTCCTGACCGATTCTGGCT CCAAACCCTCCA CCAAGTCGGCACGTCAACCACCCTGGGCATCAC AACAGAGCAACA CGGACTCCAGACTGGGGACGAGGCCGATTATTAC ACAAGTACGCGG TGCGGAACATGGGATAGCCGCCTGAGTGCTGTGG CCGAAAGCTACC TTTTCGGCGGAGGGACCAAGCTGACCGTCCTAGC TGAGCCTGACGC TAGTACAAAGGGCCCCTCCGTCTTTCCACTCGCAC CCGAGCAGTGGA CCAGTTCAAAGTCCACTTCTGGAGGCACTGCGGC AGTCCCACAGAA CTTGGGCTGTTTGGTGAAAGACTACTTCCCAGAG GCTACAGCTGCC CCAGTGACAGTCTCTTGGAATAGCGGAGCACTGA AGGTCACGCATG CCAGCGGTGTGCATACCTTTCCAGCTGTGCTGCAG AAGGGAGCACCG AGCAGCGGCCTCTACTCACTGAAGAGTGTCGTCA TGGAGAAGACAG CCGTTCCCTCTTCCAGCCTCGGCACTCAAACTTAC TGGCCCCTACAG ATCTGCAACGTGAATCATAAGCCATCTAACACCA AATGTTCA AGGTAGACAAGAAAGTC (SEQ ID NO: 597) | ATGCACTGGGTC CGCCAGGCTCCA GGCAAGGGGCTG GAGTGGGTGGCA GTTATATCATTTG ATGGAAGTATTA AGTATTCTGTAGA CTCCGTGAAGGG CCGATTCACCATC TCCAGAGACAAT TCAAAGAACACG CTGTTTCTGCAAA TGAACAGCCTGC GAGCCGAGGCA CGGCTGTGTATTA CTGTGCGAGAGA TCGGCTCAATTAC TATGATAGTAGT GGTTATTATCACT ACAAATACTACG GTATGGCCGTCTG GGGCCAAGGAAC AACAGTTACCGT CTCTAGTGGTCAG CCCAAGGCCAAC CCCACTGTCACTC TGTTCCCGCCCTC CTCTGAGGAGCT CCAAGCCAACAA GGCCACACTAGT GACTCTACCCGG GAGCTGTGACAG TGGCCTGGAAGG CAGATGGCAGCC CCGTCAAGGCGG GAGTGGAGACCA CCAAACCCTCCA AACAGAGCAACA ACAAGTACGCGG CCGAAAGCTACC TGAGCCTGACGC CCGAGCAGTGGA AGTCCCACAGAA GCTACAGCTGCC AGGTCACGCATG AAGGGAGCACCG TGGAGAAGACAG TGGCCCCTACAG AATGTTCA (SEQ ID NO: 621) |
| iPS:392514 | SEQ ID NO: 225 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGCAAGCTCCCGGTCAGGGGTTGGA GTGGATGGGAGTTATTAGCTATGACGGGGGCAAT AAGTACTACGCCGAGTCTGTTAAGGGTCGGGTCA | CAGGTGCAGCTG GTGGAATCTGGG GGAGGCGTGGTC CAGCCTGGGGAGG TCCCTGAGACTCT CCTGTGCAGCCTC |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | CAATGACACGGGACACCTCAACCAGTACACTCTA<br>TATGGAACTGTCTAGCCTGAGATCCGAGGACACC<br>GCTGTGTATTATTGCGCTAGGGGGTACGATGTATT<br>GACGGGTTATCCTGATTACTGGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA<br>GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA<br>TGCCCACCGTGCCCAGCACCTGAACTCCTGGGGG<br>GACCGTCAGTCTTCCTCTTCCCCCCAAAACCCAAG<br>GACACCCTCATGATCTCCCGGACCCCTGAGGTCA<br>CATGCGTGGTGGTGGACGTGAGCCACGAAGACCC<br>TGAGGTCAAGTTCAACTGGTACGTGGACGGCGTG<br>GAGGTGCATAATGCCAAGACAAAGCCGTGTGAGG<br>AGCAGTACGGCAGCACGTACCGTTGTGTCAGCGT<br>CCTCACCGTCCTGCACCAGGACTGGCTGAATGGC<br>AAGGAGTACAAGTGCAAGGTCTCCAACAAAGCCC<br>TCCCAGCCCCCATCGAGAAAACCATCTCCAAAGC<br>CAAAGGGCAGCCCCGAGAACCACAGGTGTACACC<br>CTGCCCCCATCCCGGGAGGAGATGACCAAGAACC<br>AGGTCAGCCTGACCTGCCTGGTCAAAGGCTTCTA<br>TCCCAGCGACATCGCCGTGGAGTGGGAGAGCAAT<br>GGGCAGCCGGAGAACAACTACAAGACCACGCCTC<br>CCGTGCTGGACTCCGACGGCTCCTTCTTCCTCTAT<br>AGCAAGCTCACCGTGGACAAGAGCAGGTGGCAG<br>CAGGGGAACGTCTTCTCATGCTCCGTGATGCATG<br>AGGCTCTGCACAACCACTACACGCAGAAGAGCCT<br>AAGCTTGTCTCCGGGTGGTGGCGGATCGGGAGGT<br>GGCGGATCCCAGTCTGTGTTGACGCAGCCGCCCT<br>CAGTGTCTGCGGCCCCAGGACAGAAGGTCACCAT<br>CTCCTGCTCTGGAAGCAGCTCCAACATTGGGAAT<br>AATTATGTATCCTGGTACCAGAAGCTCCCAGGAA<br>CAGCCCCCAAACTCCTCATTTATGACAATAATAA<br>GCGACCCTCAGGGATTCCTGACCGATTCTCTGGCT<br>CCAAGTCTGGCACGTCAACCACCCTGGGCATCAC<br>CGGACTCCAGACTGGGGACGAGGCCGATTATTAC<br>TGCGGAACATGGGATAGCCGCCTGAGTGCTGTGG<br>TTTTCGGCGGAGGGACCAAGCTGACCGTCCTAGC<br>TAGTACAAAGGGCCCCTCCGTCTTTCCACTCGCAC<br>CCAGTTCAAAGTCCACTTCTGGAGGCACTGCGGC<br>CTTGGGCTGTTTGGTGAAAGACTACTTCCCAGAG<br>CCAGTGACAGTCTCTTGGAATAGCGGAGCACTGA<br>CCAGCGGTGTGCATACCTTTCCAGCTGTGCTGCAG<br>AGCAGCGGCCTCTACTCACTGAAGAGTGTCGTCA<br>CCGTTCCCTCTTCCAGCCTCGGCACTCAAACTTAC<br>ATCTGCAACGTGAATCATAAGCCATCTAACACCA<br>AGGTAGACAAGAAAGTC<br>(SEQ ID NO: 598) | TGGATTCACCTTC<br>AGTAGCTTTGGC<br>ATGCACTGGGTC<br>CGCGAGGCTCCA<br>GGCAAGGGGCTG<br>GAGTGGGTGGCA<br>GTTATATCATTTG<br>ATGGAAGTATTA<br>AGTATTCTGTAGA<br>CTCCGTGAAGGG<br>CCGATTCACCATC<br>TCCAGAGACAAT<br>TCAAAGAACACG<br>CTGTTTCTGCAAA<br>TGAACAGCCTGC<br>GAGCCGAGGACA<br>CGGCTGTGTATTA<br>CTGTGCGAGAGA<br>TCGGCTCAATTAC<br>TATGATAGTAGT<br>GGTTATTATCACT<br>ACAAATACTACG<br>GTATGGCCGTCTG<br>GGGCCAAGGAAC<br>AACAGTTACCGT<br>CTCTAGTGGTCAG<br>CCCAAGGCCAAC<br>CCCACTGTCACTC<br>TGTTCCCGCCCTC<br>CTCTGAGGAGCT<br>CCAAGCCAACAA<br>GGCCACACTAGT<br>GTGTCTGATCAGT<br>GACTTCTACCCGG<br>GAGCTGTGACAG<br>TGGCCTGGAAGG<br>CAGATGGCAGCC<br>CCGTCAAGGCGG<br>GAGTGGAGACCA<br>CCAAACCCTCCA<br>AACAGAGCAACA<br>ACAAGTACGCGG<br>CCGAAAGCTACC<br>TGAGCCTGACGC<br>CCGAGCAGTGGA<br>AGTCCCACAGAA<br>GCTACAGCTGCC<br>AGGTCACGCATG<br>AAGGGAGCACCG<br>TGGAGAAGACAG<br>TGGCCCCTACAG<br>AATGTTCA<br>(SEQ ID NO: 622) |
| iPS:392475 | SEQ ID NO: 225 | CAAGTTCAGTTGGTGGAGTCTGGAGCCGAAGTAG<br>TAAAGCCAGGAGCTTCAGTGAAAGTCTCTTGTAA<br>AGCAAGTGGATTCACGTTTAGCCGCTTTGCCATGC<br>ATTGGGTGCGGCAAGCTCCCGGTCAGGGGTTGGA<br>GTGGATGGGAGTTATTAGCTATGACGGGGGCAAT<br>AAGTACTACGCCGAGTCTGTTAAGGGTCGGGTCA<br>CAATGACACGGGACACCTCAACCAGTACACTCTA<br>TATGGAACTGTCTAGCCTGAGATCCGAGGACACC<br>GCTGTGTATTATTGCGCTAGGGGGTACGATGTATT<br>GACGGGTTATCCTGATTACTGGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA | CAGGTGCAGCTG<br>GTGGAATCTGGG<br>GGAGGCGTGGTC<br>CAGCCTGGGAGG<br>TCCCTGAGACTCT<br>CCTGTGCAGCCTC<br>TGGATTCACCTTC<br>AGTAGCTTTGGC<br>ATGCACTGGGTC<br>CGCCAGGCTCCA<br>GGCAAGGGGCTG<br>GAGTGGGTGGCA<br>GTTATATCATTTG<br>ATGGAAGTATTA<br>AGTATTCTGTAGA<br>CTCCGTGAAGGG<br>CCGATTCACCATC |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA<br>TGCCCACCGTGCCCAGCACCTGAACTCCTGGGGG<br>GACCGTCAGTCTTCCTCTTCCCCCCAAAACCCAAG<br>GACACCCTCATGATCTCCCGGACCCCTGAGGTCA<br>CATGCGTGGTGGTGGACGTGAGCCACGAAGACCC<br>TGAGGTCAAGTTCAACTGGTACGTGGACGGCGTG<br>GAGGTGCATAATGCCAAGACAAAGCCGTGTGAGG<br>AGCAGTACGGCAGCACGTACCGTTGTGTCAGCGT<br>CCTCACCGTCCTGCACCAGGACTGGCTGAATGGC<br>AAGGAGTACAAGTGCAAGGTCTCCAACAAAGCCC<br>TCCCAGCCCCCATCGAGAAAACCATCTCCAAAGC<br>CAAAGGGCAGCCCCGAGAACCACAGGTGTACACC<br>CTGCCCCCATCCCGGGAGGAGATGACCAAGAACC<br>AGGTCAGCCTGACCTGCCTGGTCAAAGGCTTCTA<br>TCCCAGCGACATCGCCGTGGAGTGGGAGAGCAAT<br>GGGCAGCCGGAGAACAACTACAAGACCACGCCTC<br>CCGTGCTGGACTCCGACGGCTCCTTCTTCCTCTAT<br>AGCAAGCTCACCGTGGACAAGAGCAGGTGGCAG<br>CAGGGGAACGTCTTCTCATGCTCCGTGATGCATG<br>AGGCTCTGCACAACCACTACACGCAGAAGAGCCT<br>AAGCTTGTCTCCGGGTGGTGGCGGATCGGGAGGT<br>GGCGGATCCCAGTCTGTGTTGACGCAGCCGCCCT<br>CAGTGTCTGCGGCCCCAGGACAGAAGGTCACCAT<br>CTCCTGCTCTGGAAGCAGCTCCAACATTGGGAAT<br>AATTATGTATCCTGGTACCAGCAGCTCCCAGGAA<br>CAGCCCCCAAACTCCTCATTTATGACAATAATAA<br>GCGACCCTCAGGGATTCCTGACCGATTCTCTGGCT<br>CCAAGTCTGGCACGTCAACCACCCTGGGCATCAC<br>CGGACTCCAGACTGGGGACGAGGCCGATTATTAC<br>TGCGGAACATGGGATAGCCGCCTGAGTGCTGTGG<br>TTTTCGGCGGAGGGACCAAGCTGACCGTCCTAGC<br>TAGTACAAAGGGCCCCTCCGTCTTTCCACTCGCAC<br>CCAGTTCAAAGTCCACTTCTGGAGGCACTGCGGC<br>CTTGGGCTGTTTGGTGAAAGACTACTTCCCAGAG<br>CCAGTGACAGTCTCTTGGAATAGCGGAGCACTGA<br>CCAGCGGTGTGCATACCTTTCCAGCTGTGCTGCAG<br>AGCAGCGGCCTCTACTCACTGAAGAGTGTCGTCA<br>CCGTTCCCTCTTCCAGCCTCGGCACTCAAACTTAC<br>ATCTGCAACGTGAATCATAAGCCATCTAACACCA<br>AGGTAGACAAGAAAGTC<br>(SEQ ID NO: 599) | TCCAGAGACAAT<br>TCAAAGAACACG<br>CTGTTTCTGCAAA<br>TGAACAGCCTGC<br>GAGCCGAGGACA<br>CGGCTGTGTATTA<br>CTGTGCGAGAGA<br>TCGGCTCAATTAC<br>TATGAAAGTAGT<br>GGTTATTATCACT<br>ACAAATACTACG<br>GTATGGCCGTCTG<br>GGGCCAAGGAAC<br>AACAGTTACCGT<br>CTCTAGTGGTCAG<br>CCCAAGGCCAAC<br>CCCACTGTCACTC<br>TGTTCCCGCCCTC<br>CTCTGAGGAGCT<br>CCAAGCCAACAA<br>GGCCACACTAGT<br>GTGTCTGATCAGT<br>GACTTCTACCCGG<br>GAGCTGTGACAG<br>TGGCCTGGAAGG<br>CAGATGGCAGCC<br>CCGTCAAGGCGG<br>GAGTGGAGACCA<br>CCAAACCCTCCA<br>AACAGAGCAACA<br>ACAAGTACGCGG<br>CCGAAAGCTACC<br>TGAGCCTGACGC<br>CCGAGCAGTGGA<br>AGTCCCACAGAA<br>GCTACAGCTGCC<br>AGGTCACGCATG<br>AAGGGAGCACCG<br>TGGAGAAGACAG<br>TGGCCCCTACAG<br>AATGTTCA<br>(SEQ ID NO: 623) |
| iPS:392519 | SEQ ID NO: 225 | CAAGTTCAGTTGGTGGAGTCTGGAGCCGAAGTAG<br>TAAAGCCAGGAGCTTCAGTGAAAGTCTCTTGTAA<br>AGCAAGTGGATTCACGTTTAGCCGCTTTGCCATGC<br>ATTGGGTGCGGCAAGCTCCCGGTCAGGGGTTGGA<br>GTGGATGGGAGTTATTAGCTATGACGGGGGCAAT<br>AAGTACTACGCCGAGTCTGTTAAGGGTCGGGTCA<br>CAATGACACGGGACACCTCAACCAGTACACTCTA<br>TATGGAACTGTCTAGCCTGAGATCCGAGGACACC<br>GCTGTGTATTATTGCGCTAGGGGGTACGATGTATT<br>GACGGGTTATCCTGATTACTGGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA<br>GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA<br>TGCCCACCGTGCCCAGCACCTGAACTCCTGGGGG<br>GACCGTCAGTCTTCCTCTTCCCCCCAAAACCCAAG<br>GACACCCTCATGATCTCCCGGACCCCTGAGGTCA<br>CATGCGTGGTGGTGGACGTGAGCCACGAAGACCC<br>TGAGGTCAAGTTCAACTGGTACGTGGACGGCGTG<br>GAGGTGCATAATGCCAAGACAAAGCCGTGTGAGG<br>AGCAGTACGGCAGCACGTACCGTTGTGTCAGCGT<br>CCTCACCGTCCTGCACCAGGACTGGCTGAATGGC | CAGGTGCAGCTG<br>GTGGAATCTGGG<br>GGAGGCGTGGTC<br>CAGCCTGGGAGG<br>TCCCTGAGACTCT<br>CCTGTGCAGCCTC<br>TGGATTCACCTTC<br>AGTAGCTTTGGC<br>ATGCACTGGGTC<br>CGCGAGGCTCCA<br>GGCAAGGGGCTG<br>GAGTGGGTGGCA<br>GTTATATCATTTG<br>ATGGAAGTATTA<br>AGTATTCTGTAGA<br>CTCCGTGAAGGG<br>CCGATTCACCATC<br>TCCAGAGACAAT<br>TCAAAGAACACG<br>CTGTTTCTGCAAA<br>TGAACAGCCTGC<br>GAGCCGAGGACA<br>CGGCTGTGTATTA<br>CTGTGCGAGAGA<br>TCGGCTCAATTAC<br>TATGAAAGTAGT<br>GGTTATTATCACT<br>ACAAATACTACG |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | AAGGAGTACAAGTGCAAGGTCTCCAACAAAGCCC<br>TCCCAGCCCCCATCGAGAAAACCATCTCCAAAGC<br>CAAAGGGCAGCCCCGAGAACCACAGGTGTACACC<br>CTGCCCCCATCCCGGGAGGAGATGACCAAGAACC<br>AGGTCAGCCTGACCTGCCTGGTCAAAGGCTTCTA<br>TCCCAGCGACATCGCCGTGGAGTGGGAGAGCAAT<br>GGGCAGCCGGAGAACAACTACAAGACCACGCCTC<br>CCGTGCTGGACTCCGACGGCTCCTTCTTCCTCTAT<br>AGCAAGCTCACCGTGGACAAGAGCAGGTGGCAG<br>CAGGGGAACGTCTTCTCATGCTCCGTGATGCATG<br>AGGCTCTGCACAACCACTACACGCAGAAGAGCCT<br>AAGCTTGTCTCCGGGTGGTGGCGGATCGGGAGGT<br>GGCGGATCCCAGTCTGTGTTGACGCAGCCGCCCT<br>CAGTGTCTGCGGCCCCAGGACAGAAGGTCACCAT<br>CTCCTGCTCTGGAAGCAGCTCCAACATTGGGAAT<br>AATTATGTATCCTGGTACCAGAAGCTCCCAGGAA<br>CAGCCCCCAAACTCCTCATTTATGACAATAATAA<br>GCGACCCTCAGGGATTCCTGACCGATTCTCTGGCT<br>CCAAGTCTGGCACGTCAACCACCCTGGGCATCAC<br>CGGACTCCAGACTGGGGACGAGGCCGATTATTAC<br>TGCGGAACATGGGATAGCCGCCTGAGTGCTGTGG<br>TTTTCGGCGGAGGGACCAAGCTGACCGTCCTAGC<br>TAGTACAAAGGGCCCCTCCGTCTTTCCACTCGCAC<br>CCAGTTCAAAGTCCACTTCTGGAGGCACTGCGGC<br>CTTGGGCTGTTTGGTGAAAGACTACTTCCCAGAG<br>CCAGTGACAGTCTCTTGGAATAGCGGAGCACTGA<br>CCAGCGGTGTGCATACCTTTCCAGCTGTGCTGCAG<br>AGCAGCGGCCTCTACTCACTGAAGAGTGTCGTCA<br>CCGTTCCCTCTTCCAGCCTCGGCACTCAAACTTAC<br>ATCTGCAACGTGAATCATAAGCCATCTAACACCA<br>AGGTAGACAAGAAAGTC<br>(SEQ ID NO: 600) | GTATGGCCGTCTG<br>GGGCCAAGGAAC<br>AACAGTTACCGT<br>CTCTAGTGGTCAG<br>CCCAAGGCCAAC<br>CCCACTGTCACTC<br>TGTTCCCGCCCTC<br>CTCTGAGGAGCT<br>CCAAGCCAACAA<br>GGCCACACTAGT<br>GTGTCTGATCAGT<br>GACTTCTACCCGG<br>GAGCTGTGACAG<br>TGGCCTGGAAGG<br>CAGATGGCAGCC<br>CCGTCAAGGCGG<br>GAGTGGGAGACCA<br>CCAAACCCTCCA<br>AACAGAGCAACA<br>ACAAGTACGCGG<br>CCGAAAGCTACC<br>TGAGCCTGACGC<br>CCGAGCAGTGGA<br>AGTCCCACAGAA<br>GCTACAGCTGCC<br>AGGTCACGCATG<br>AAGGGAGCACCG<br>TGGAGAAGACAG<br>TGGCCCCTACAG<br>AATGTTCA<br>(SEQ ID NO: 624) |
| iPS:392515 | SEQ ID NO: 225 | CAAGTTCAGTTGGTGGAGTCTGGAGCCGAAGTAG<br>TAAAGCCAGGAGCTTCAGTGAAAGTCTCTTGTAA<br>AGCAAGTGGATTCACGTTTAGCCGCTTTGCCATGC<br>ATTGGGTGCGGCAAGCTCCCGGTCAGGGGTTGGA<br>GTGGATGGGAGTTATTACCTATGACGGGGGCAAT<br>AAGTACTACGCCGAGTCTGTTAAGGGTCGGGTCA<br>CAATGACACGGGACACCTCAACCAGTACACTCTA<br>TATGGAACTGTCTAGCCTGAGATCCGAGGACACC<br>GCTGTGTATTATTGCGCTAGGGGGTACGATGTATT<br>GACGGGTTATCCTGATTACTGGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA<br>GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA<br>TGCCCACCGTGCCCAGCACCTGAACTCCTGGGGG<br>GACCGTCAGTCTTCCTCTTCCCCCCAAAACCCAAG<br>GACACCCTCATGATCTCCCGGACCCCTGAGGTCA<br>CATGCGTGGTGGTGGACGTGAGCCACGAAGACCC<br>TGAGGTCAAGTTCAACTGGTACGTGGACGGCGTG<br>GAGGTGCATAATGCCAAGACAAAGCCGTGTGAGG<br>AGCAGTACGCAGCACGTACCGTTGTGTCAGCGT<br>CCTCACCGTCCTGCACCAGGACTGGCTGAATGGC<br>AAGGAGTACAAGTGCAAGGTCTCCAACAAAGCCC<br>TCCCAGCCCCCATCGAGAAAACCATCTCCAAAGC<br>CAAAGGGCAGCCCCGAGAACCACAGGTGTACACC<br>CTGCCCCCATCCCGGGAGGAGATGACCAAGAACC<br>AGGTCAGCCTGACCTGCCTGGTCAAAGGCTTCTA<br>TCCCAGCGACATCGCCGTGGAGTGGGAGAGCAAT<br>GGGCAGCCGGAGAACAACTACAAGACCACGCCTC<br>CCGTGCTGGACTCCGACGGCTCCTTCTTCCTCTAT<br>AGCAAGCTCACCGTGGACAAGAGCAGGTGGCAG<br>CAGGGGAACGTCTTCTCATGCTCCGTGATGCATG<br>AGGCTCTGCACAACCACTACACGCAGAAGAGCCT | CAGGTGCAGCTG<br>GTGGAATCTGGG<br>GGAGGCGTGGTC<br>CAGCCTGGGAGG<br>TCCCTGAGACTCT<br>CCTGTGCAGCCTC<br>TGGATTCACCTTC<br>AGTAGCTTTGGC<br>ATGCACTGGGTC<br>CGCCAGGCTCCA<br>GGCAAGGGGCTG<br>GAGTGGGTGGCA<br>GTTATATCATTTG<br>ATGGAAGTATTA<br>AGTATTCTGTAGA<br>CTCCGTGAAGGG<br>CCGATTCACCATC<br>TCCAGAGACAAT<br>TCAAAGAACACG<br>CTGTTTCTGCAAA<br>TGAACAGCCTGC<br>GAGCCGAGGACA<br>CGGCTGTGTATTA<br>CTGTGCGAGAGA<br>TCGGCTCAATTAC<br>TATGATAGTAGT<br>GGTTATTATCACT<br>ACAAATACTACG<br>GTATGGCCGTCTG<br>GGGCCAAGGAAC<br>AACAGTTACCGT<br>CTCTAGTGCCTCC<br>ACCAAGGGCCCA<br>TCGGTCTTCCCCC<br>TGGCACCCTCCTC<br>CAAGAGCACCTC<br>TGGGGGCACAGC<br>GGCCCTGGGCTG<br>CCTGGTCAAGGA |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | AAGCTTGTCTCCGGGTGGTGGCGGATCGGGAGGT GGCGGATCCCAGTCTGTGTTGACGCAGCCGCCCT CAGTGTCTGCGGCCCCAGGACAGAAGGTCACCAT CTCCTGCTCTGGAAGCAGCTCCAACATTGGGAAT AATTATGTATCCTGGTACCAGCAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 601) | CTACTTCCCCGAA CCGGTGACGGTG TCGTGGAACTCA GGCGCCCTGACC AGCGGCGTGCAC ACCTTCCCGGCTG TCCTACAGTCCTC AGGACTCTACTCC CTCGAAAGCGTG GTGACCGTGCCCT CCAGCAGCTTGG GCACCCAGACCT ACATCTGCAACG TGAATCACAAGC CCAGCAACACCA AGGTGGACAAGA AAGTT (SEQ ID NO: 625) |
| iPS:392516 | SEQ ID NO: 225 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGCAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT GACGGGTTATCCTGATTACTGGGGCAGGGGACA CTCGTAACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCCT CAGTGTCTGCGGCCCCAGGACAGAAGGTCACCAT CTCCTGCTCTGGAAGCAGCTCCAACATTGGGAAT AATTATGTATCCTGGTACCAGAAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG | CAGGTGCAGCTG GTGGAATCTGGG GGAGGCGTGGTC CAGCCTGGGAGG TCCCTGAGACTCT CCTGTGCAGCCTC TGGATTCACCTTC AGTAGCTTTGGC ATGCACTGGGTC CGCGAGGCTCCA GGCAAGGGGCTG GAGTGGGTGGCA GTTATATCATTTG ATGGAAGTATTA AGTATTCTGTAGA CTCCGTGAAGGG CCGATTCACCATC TCCAGAGACAAT TCAAAGAACACG CTGTTTCTGCAAA TGAACAGCCTGC GAGCCGAGGACA CGGCTGTGTATTA CTGTGCGAGAGA TCGGCTCAATTAC TATGATAGTAGT GGTTATTATCACT ACAAATACTACG GTATGGCCGTCTG GGGCCAAGGAAC AACAGTTACCGT CTCTAGTGCCTCC ACCAAGGGCCCA TCGGTCTTCCCCC TGGCACCCTCCTC CAAGAGCACCTC TGGGGGCACAGC GGCCCTGGGCTG CCTGGTCAAGGA CTACTTCCCCGAA CCGGTGACGGTG TCGTGGAACTCA GGCGCCCTGACC AGCGGCGTGCAC ACCTTCCCGGCTG TCCTACAGTCCTC AGGACTCTACTCC CTCGAAAGCGTG GTGACCGTGCCCT CCAGCAGCTTGG |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 602) | GCACCCAGACCT ACATCTGCAACG TGAATCACAAGC CCAGCAACACCA AGGTGGACAAGA AAGTT (SEQ ID NO: 626) |
| iPS:392521 | SEQ ID NO: 225 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGCAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT GACGGGTTATCCTGATTACTGGGGGCAGGGGACA CTCGTAACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCCT CAGTGTCTGCGGCCCCAGGACAGAAGGTCACCAT CTCCTGCTCTGGAAGCAGCTCCAACATTGGGAAT AATTATGTATCCTGGTACCAGAAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 603) | CAGGTGCAGCTG GTGGAATCTGGG GGAGGCGTGGTC CAGCCTGGGAGG TCCCTGAGACTCT CCTGTGCAGCCTC TGGATTCACCTTC AGTAGCTTTGGC ATGCACTGGGTC CGCGAGGCTCCA GGCAAGGGGCTG GAGTGGGTGGCA GTTATATCATTTG ATGGAAGTATTA AGTATTCTGTAGA CTCCGTGAAGGG CCGATTCACCATC TCCAGAGACAAT TCAAAGAACACG CTGTTTCTGCAAA TGAACAGCCTGC GAGCCGAGGACA CGGCTGTGTATTA CTGTGCGAGAGA TCGGCTCAATTAC TATGAAAGTAGT GGTTATTATCACT ACAAATACTACG GTATGGCCGTCTG GGGCCAAGGAAC AACAGTTACCGT CTCTAGTGCCTCC ACCAAGGGCCCA TCGGTCTTCCCCC TGGCACCCTCCTC CAAGAGCACCTC TGGGGGCACAGC GGCCCTGGGCTG CCTGGTCAAGGA CTACTTCCCCGAA CCGGTGACGGTG TCGTGGAACTCA GGCGCCCTGACC AGCGGCGTGCAC ACCTTCCCGGCTG TCCTACAGTCCTC AGGACTCTACTCC CTCGAAAGCGTG GTGACCGTGCCCT CCAGCAGCTTGG GCACCCAGACCT ACATCTGCAACG TGAATCACAAGC CCAGCAACACCA AGGTGGACAAGA AAGTT (SEQ ID NO: 627) |

263
264

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| iPS:392520 | SEQ ID NO: 225 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGCAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT GACGGGTTATCCTGATTACTGGGGGCAGGGGACA CTCGTAACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCCT CAGTGTCTGCGGCCCAGGACAGAAGGTCACCAT CTCCTGCTCTGGAAGCAGCTCCAACATTGGGAAT AATTATGTATCCTGGTACCAGCAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 604) | CAGGTGCAGCTG GTGGAATCTGGG GGAGGCGTGGTC CAGCCTGGGAGG TCCCTGAGACTCT CCTGTGCAGCCTC TGGATTCACCTTC AGTAGCTTTGGC ATGCACTGGGTC CGCCAGGCTCCA GGCAAGGGGCTG GAGTGGGTGGCA GTTATATCATTTG ATGGAAGTATTA AGTATTCTGTAGA CTCCGTGAAGGG CCGATTCACCATC TCCAGAGACAAT TCAAAGAACACG CTGTTTCTGCAAA TGAACAGCCTGC GAGCCGAGGACA CGGCTGTGTATTA CTGTGCGAGAGA TCGGCTCAATTAC TATGAAAGTAGT GGTTATTATCACT ACAAATACTACG GTATGGCCGTCTG GGGCCAAGGAAC AACAGTTACCGT CTCTAGTGCCTCC ACCAAGGGCCCA TCGGTCTTCCCCC TGGCACCCTCCTC CAAGAGCACCTC TGGGGGCACAGC GGCCCTGGGCTG CCTGGTCAAGGA CTACTTCCCCGAA CCGGTGACGGTG TCGTGGAACTCA GGCGCCCTGACC AGCGGCGTGCAC ACCTTCCCGGCTG TCCTACAGTCCTC AGGACTCTACTCC CTCGAAAGCGTG GTGACCGTGCCCT CCAGCAGCTTGG GCACCCAGACCT ACATCTGCAACG TGAATCACAAGC CCAGCAACACCA AGGTGGACAAGA AAGTT (SEQ ID NO: 628) |
| iPS:392517 | GATATCCAG CTCACTCAA TCGCCATCA TTTCTCTCCG CTTCGGTAG GCGACCGGG TCACGATCA CATGCAGGG CGTCGCAAA GCATTGGGA GGTCGTTGC | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGAAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT GACGGGTTATCCTGATTACTGGGGGCAGGGGACA CTCGTAACCGTCTCTAGTGCCTCCACCAAGGGCCC | SEQ ID NO: 625 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | ATTGGTATC AGGAGAAAC CCGGAAAGG CCCCGAAAC TTCTGATCA AATACGCAT CACAAAGTT TGAGCGGTG TGCCGTCGC GCTTCTCCG GTTCCGGAA GCGGAACGG AGTTCACGC TTACAATCT CCTCACTGC AGCCCGAGG ATTTCGCGA CCTATTACT GTCACCAGT CATCCAGAC TCCCGTTTAC TTTTGGCCCT GGGACCAAG GTGGACATT AAGCGTACG GTGGCTGCA CCATCTGTCT TCATCTTCCC GCCATCTGA TGAGCAGTT GAAATCTGG AACTGCCTC TGTTGTGTG CCTGCTGAA TAACTTCTAT CCCAGAGAG GCCAAAGTA CAGTGGAAG GTGGATAAC GCCCTCCAA TCGGGTAAC TCCCAGGAG AGTGTCACA GAGCAGGAC AGCAAGGAC AGCACCTAC AGCCTCGAA AGCACCCTG ACGCTGAGC AAAGCAGAC TACGAGAAA CACAAAGTC TACGCCTGC GAAGTCACC CATCAGGGC CTGAGCTCG CCCGTCACA AAGAGCTTC AACAGGGGA GAGTGT (SEQ ID NO: 595) | ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCCT CAGTGTCTGCGGCCCAGGACAGAAGGTCACCAT CTCCTGCTCTGGAAGCAGCTCCAACATTGGGAAT AATTATGTATCCTGGTACCAGCAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 605) | |
| iPS:392518 | SEQ ID NO: 595 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGAAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT | SEQ ID NO: 626 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | GACGGGTTATCCTGATTACTGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA<br>GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA<br>TGCCCACCGTGCCCAGCACCTGAACTCCTGGGGG<br>GACCGTCAGTCTTCCTCTTCCCCCCAAAACCCAAG<br>GACACCCTCATGATCTCCCGGACCCCTGAGGTCA<br>CATGCGTGGTGGTGGACGTGAGCCACGAAGACCC<br>TGAGGTCAAGTTCAACTGGTACGTGGACGGCGTG<br>GAGGTGCATAATGCCAAGACAAAGCCGTGTGAGG<br>AGCAGTACGGCAGCACGTACCGTTGTGTCAGCGT<br>CCTCACCGTCCTGCACCAGGACTGGCTGAATGGC<br>AAGGAGTACAAGTGCAAGGTCTCCAACAAAGCCC<br>TCCCAGCCCCCATCGAGAAAACCATCTCCAAAGC<br>CAAAGGGCAGCCCCGAGAACCACAGGTGTACACC<br>CTGCCCCCATCCCGGGAGGAGATGACCAAGAACC<br>AGGTCAGCCTGACCTGCCTGGTCAAAGGCTTCTA<br>TCCCAGCGACATCGCCGTGGAGTGGGAGAGCAAT<br>GGGCAGCCGGAGAACAACTACAAGACCACGCCTC<br>CCGTGCTGGACTCCGACGGCTCCTTCTTCCTCTAT<br>AGCAAGCTCACCGTGGACAAGAGCAGGTGGCAG<br>CAGGGGAACGTCTTCTCATGCTCCGTGATGCATG<br>AGGCTCTGCACAACCACTACACGCAGAAGAGCCT<br>AAGCTTGTCTCCGGGTGGTGGCGGATCGGGAGGT<br>GGCGGATCCCAGTCTGTGTTGACGCAGCCGCCCT<br>CAGTGTCTGCGGCCCCAGGACAGAAGGTCACCAT<br>CTCCTGCTCTGGAAGCAGCTCCAACATTGGGAAT<br>AATTATGTATCCTGGTACCAGAAGCTCCCAGGAA<br>CAGCCCCCAAACTCCTCATTTATGACAATAATAA<br>GCGACCCTCAGGGATTCCTGACCGATTCTCTGGCT<br>CCAAGTCTGGCACGTCAACCACCCTGGGCATCAC<br>CGGACTCCAGACTGGGGACGAGGCCGATTATTAC<br>TGCGGAACATGGGATAGCCGCCTGAGTGCTGTGG<br>TTTTCGGCGGAGGGACCAAGCTGACCGTCCTAGG<br>TCAGCCCAAGGCCAACCCCACTGTCACTCTGTTCC<br>CGCCCTCCTCTGAGGAGCTCCAAGCCAACAAGGC<br>CACACTAGTGTGTCTGATCAGTGACTTCTACCCGG<br>GAGCTGTGACAGTGGCCTGGAAGGCAGATGGCAG<br>CCCCGTCAAGGCGGGAGTGGAGACCACCAAACCC<br>TCCAAACAGAGCAACAACAAGTACGCGGCCAAG<br>AGCTACCTGAGCCTGACGCCCGAGCAGTGGAAGT<br>CCCACAGAAGCTACAGCTGCCAGGTCACGCATGA<br>AGGGAGCACCGTGGAGAAGACAGTGGCCCCTAC<br>AGAATGTTCA (SEQ ID NO: 606) | |
| iPS:392522 | SEQ ID NO: 595 | CAAGTTCAGTTGGTGGAGTCTGGAGCCGAAGTAG<br>TAAAGCCAGGAGCTTCAGTGAAAGTCTCTTGTAA<br>AGCAAGTGGATTCACGTTTAGCCGCTTTGCCATGC<br>ATTGGGTGCGGAAAGCTCCCGGTCAGGGGTTGGA<br>GTGGATGGGAGTTATTAGCTATGACGGGGGCAAT<br>AAGTACTACGCCGAGTCTGTTAAGGGTCGGGTCA<br>CAATGACACGGGACACCTCAACCAGTACACTCTA<br>TATGGAACTGTCTAGCCTGAGATCCGAGGACACC<br>GCTGTGTATTATTGCGCTAGGGGGTACGATGTATT<br>GACGGGTTATCCTGATTACTGGGGCAGGGGACA<br>CTCGTAACCGTCTCTAGTGCCTCCACCAAGGGCCC<br>ATCGGTCTTCCCCCTGGCACCCTCCTCCAAGAGCA<br>CCTCTGGGGGCACAGCGGCCCTGGGCTGCCTGGT<br>CAAGGACTACTTCCCCGAACCGGTGACGGTGTCG<br>TGGAACTCAGGCGCCCTGACCAGCGGCGTGCACA<br>CCTTCCCGGCTGTCCTACAGTCCTCAGGACTCTAC<br>TCCCTCAAAAGCGTGGTGACCGTGCCCTCCAGCA<br>GCTTGGGCACCCAGACCTACATCTGCAACGTGAA<br>TCACAAGCCCAGCAACACCAAGGTGGACAAGAA<br>AGTTGAGCCCAAATCTTGTGACAAAACTCACACA | SEQ ID NO: 628 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC CTGCCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCT CAGTGTCTGCGGCCCCAGGACAGAAGGTCACCAT CTCCTGCTCTGGAAGCAGCTCCAACATTGGGAAT AATTATGTATCCTGGTACCAGCAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 607) | |
| iPS:392523 | SEQ ID NO: 595 | CAAGTTCAGTTGGTGGAGTCTGGAGCCGAAGTAG TAAAGCCAGGAGCTTCAGTGAAAGTCTCTTGTAA AGCAAGTGGATTCACGTTTAGCCGCTTTGCCATGC ATTGGGTGCGGAAAGCTCCCGGTCAGGGGTTGGA GTGGATGGGAGTTATTAGCTATGACGGGGGCAAT AAGTACTACGCCGAGTCTGTTAAGGGTCGGGTCA CAATGACACGGGACACCTCAACCAGTACACTCTA TATGGAACTGTCTAGCCTGAGATCCGAGGACACC GCTGTGTATTATTGCGCTAGGGGGTACGATGTATT GACGGGTTATCCTGATTACTGGGGCAGGGGACA CTCGTAACCGTCTCTAGTGCCTCCACCAAGGGCCC ATCGGTCTTCCCCCTGGCACCCTCCTCCAAGAGCA CCTCTGGGGGCACAGCGGCCCTGGGCTGCCTGGT CAAGGACTACTTCCCCGAACCGGTGACGGTGTCG TGGAACTCAGGCGCCCTGACCAGCGGCGTGCACA CCTTCCCGGCTGTCCTACAGTCCTCAGGACTCTAC TCCCTCAAAAGCGTGGTGACCGTGCCCTCCAGCA GCTTGGGCACCCAGACCTACATCTGCAACGTGAA TCACAAGCCCAGCAACACCAAGGTGGACAAGAA AGTTGAGCCCAAATCTTGTGACAAAACTCACACA TGCCCACCGTGCCCAGCACCTGAACTCCTGGGGG GACCGTCAGTCTTCCTCTTCCCCCCAAAACCCAAG GACACCCTCATGATCTCCCGGACCCCTGAGGTCA CATGCGTGGTGGTGGACGTGAGCCACGAAGACCC TGAGGTCAAGTTCAACTGGTACGTGGACGGCGTG GAGGTGCATAATGCCAAGACAAAGCCGTGTGAGG AGCAGTACGGCAGCACGTACCGTTGTGTCAGCGT CCTCACCGTCCTGCACCAGGACTGGCTGAATGGC AAGGAGTACAAGTGCAAGGTCTCCAACAAAGCCC TCCCAGCCCCCATCGAGAAAACCATCTCCAAAGC CAAAGGGCAGCCCCGAGAACCACAGGTGTACACC | SEQ ID NO: 627 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | CTGCCCCATCCCGGGAGGAGATGACCAAGAACC AGGTCAGCCTGACCTGCCTGGTCAAAGGCTTCTA TCCCAGCGACATCGCCGTGGAGTGGGAGAGCAAT GGGCAGCCGGAGAACAACTACAAGACCACGCCTC CCGTGCTGGACTCCGACGGCTCCTTCTTCCTCTAT AGCAAGCTCACCGTGGACAAGAGCAGGTGGCAG CAGGGGAACGTCTTCTCATGCTCCGTGATGCATG AGGCTCTGCACAACCACTACACGCAGAAGAGCCT AAGCTTGTCTCCGGGTGGTGGCGGATCGGGAGGT GGCGGATCCCAGTCTGTGTTGACGCAGCCGCCCT CAGTGTCTGCGGCCCCAGGACAGAAGGTCACCAT CTCCTGCTCTGGAAGCAGCTCCAACATTGGGAAT AATTATGTATCCTGGTACCAGAAGCTCCCAGGAA CAGCCCCCAAACTCCTCATTTATGACAATAATAA GCGACCCTCAGGGATTCCTGACCGATTCTCTGGCT CCAAGTCTGGCACGTCAACCACCCTGGGCATCAC CGGACTCCAGACTGGGGACGAGGCCGATTATTAC TGCGGAACATGGGGATAGCCGCCTGAGTGCTGTGG TTTTCGGCGGAGGGACCAAGCTGACCGTCCTAGG TCAGCCCAAGGCCAACCCCACTGTCACTCTGTTCC CGCCCTCCTCTGAGGAGCTCCAAGCCAACAAGGC CACACTAGTGTGTCTGATCAGTGACTTCTACCCGG GAGCTGTGACAGTGGCCTGGAAGGCAGATGGCAG CCCCGTCAAGGCGGGAGTGGAGACCACCAAACCC TCCAAACAGAGCAACAACAAGTACGCGGCCAAG AGCTACCTGAGCCTGACGCCCGAGCAGTGGAAGT CCCACAGAAGCTACAGCTGCCAGGTCACGCATGA AGGGAGCACCGTGGAGAAGACAGTGGCCCCTAC AGAATGTTCA (SEQ ID NO: 608) | |
| | | Anti-CGRP Receptor IgG x Anti-PAC1 Receptor Fab | |
| iPS:392524 | CAGTCTGTG TTGACGCAG CCGCCCTCA GTGTCTGCG GCCCCAGGA CAGAAGGTC ACCATCTCC TGCTCTGGA AGCAGCTCC AACATTGGG AATAATTAT GTATCCTGG TACCAGCAG CTCCCAGGA ACAGCCCCC AAACTCCTC ATTTATGAC AATAATAAG CGACCCTCA GGGATTCCT GACCGATTC TCTGGCTCC AAGTCTGGC ACGTCAACC ACCCTGGGC ATCACCGGA CTCCAGACT GGGGACGAG GCCGATTAT TACTGCGGA ACATGGGAT AGCCGCCTG AGTGCTGTG GTTTTCGGC GGAGGGACC AAGCTGACC GTCCTAGGT CAGCCCAAG GCCAACCCC ACTGTCACT | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCAGCAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GAACGTCTTCTCATGCTCCGTGATGCATGAGGCT CTGCACAACCACTACACGCAGAAGAGCCTAAGCT | CAAGTTCAGTTG GTGGAGTCTGGA GCCGAAGTAGTA AAGCCAGGAGCT TCAGTGAAAGTC TCTTGTAAAGCA AGTGGATTCACG TTTAGCCGCTTTG CCATGCATTGGGT GCGGCAGCTCC CGGTCAGGGGTT GGAGTGGATGGG AGTTATTAGCTAT GACGGGGCAAT AAGTACTACGCC GAGTCTGTTAAG GGTCGGGTCACA ATGACACGGGAC ACCTCAACCAGT ACACTCTATATGG AACTGTCTAGCCT GAGATCCGAGGA CACCGCTGTGTAT TATTGCGCTAGG GGGTACGATGTA TTGACGGGTTATC CTGATTACTGGG GCCAGGGGACAC TCGTAACCGTCTC TAGTACGGTGGC TGCACCATCTGTC TTCATCTTCCCGC CATCTGATGAGC AGTTGAAATCTG GAACTGCCTCTGT TGTGTGCCTGCTG AATAACTTCTATC CCAGAGAGGCCA AAGTACAGTGGA AGGTGGATAACG |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | CTGTTCCCG CCCTCCTCTG AGGAGCTCC AAGCCAACA AGGCCACAC TAGTGTGTC TGATCAGTG ACTTCTACC CGGGAGCTG TGACAGTGG CCTGGAAGG CAGATGGCA GCCCCGTCA AGGCGGGAG TGGAGACCA CCAAACCCT CCAAACAGA GCAACAACA AGTACGCGG CCAAGAGCT ACCTGAGCC TGACGCCCG AGCAGTGGA AGTCCCACA GAAGCTACA GCTGCCAGG TCACGCATG AAGGGAGCA CCGTGGAGA AGACAGTGG CCCCTACAG AATGTTCA (SEQ ID NO: 287) | TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGCAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTGCTAGTACAAAGGG CCCCTCCGTCTTTCCACTCGCACCCAGTTCAAAGT CCACTTCTGGAGGCACTGCGGCCTTGGGCTGTTTG GTGAAAGACTACTTCCCAGAGCCAGTGACAGTCT CTTGGAATAGCGGAGCACTGACCAGCGGTGTGCA TACCTTTCCAGCTGTGCTGCAGAGCAGCGGCCTCT ACTCACTGGAGAGTGTCGTCACCGTTCCCTCTTCC AGCCTCGGCACTCAAACTTACATCTGCAACGTGA ATCATAAGCCATCTAACACCAAGGTAGACAAGAA AGTC (SEQ ID NO: 609) | CCCTCCAATCGG GTAACTCCCAGG AGAGTGTCACAG AGCAGGACAGCA AGGACAGCACCT ACAGCCTCAAGA GCACCCTGACGC TGAGCAAAGCAG ACTACGAGAAAC ACAAAGTCTACG CCTGCGAAGTCA CCCATCAGGGCC TGAGCTCGCCCGT CACAAAGAGCTT CAACAGGGGAGA GTGT (SEQ ID NO: 629) |
| iPS:392525 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAAAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA | CAAGTTCAGTTG GTGGAGTCTGGA GCCGAAGTAGTA AAGCCAGGAGCT TCAGTGAAAGTC TCTTGTAAAGCA AGTGGATTCACG TTTAGCCGCTTTG CCATGCATTGGGT GCGGAAAGCTCC CGGTCAGGGGTT GGAGTGGATGGG AGTTATTAGCTAT GACGGGGGCAAT AAGTACTACGCC GAGTCTGTTAAG GGTCGGGTCACA ATGACACGGGAC ACCTCAACCAGT ACACTCTATATGG AACTGTCTAGCCT GAGATCCGAGGA CACCGCTGTGTAT TATTGCGCTAGG GGGTACGATGTA TTGACGGGTTATC CTGATTACTGGG GGCAGGGGACAC TCGTAACCGTCTC TAGTACGGTGGC TGCACCATCTGTC TTCATCTTCCCGC CATCTGATGAGC AGTTGAAATCTG GAACTGCCTCTGT TGTGTGCCTGCTG AATAACTTCTATC |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | AGCTCACCGTGGACAAGAGCAGGTGGCAGCAGG GGAACGTCTTCTCATGCTCCGTGATGCATGAGGCT CTGCACAACCACTACACGCAGAAGAGCCTAAGCT TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGGAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTGCTAGTACAAAGGG CCCCTCCGTCTTTCCACTCGCACCCAGTTCAAAGT CCACTTCTGGAGGCACTGCGGCCTTGGGCTGTTTG GTGAAAGACTACTTCCCAGAGCCAGTGACAGTCT CTTGGAATAGCGGAGCACTGACCAGCGGTGTGCA TACCTTTCCAGCTGTGCTGCAGAGCAGCGGCCTCT ACTCACTGGAGAGTGTCGTCACCGTTCCCTCTTCC AGCCTCGGCACTCAAACTTACATCTGCAACGTGA ATCATAAGCCATCTAACACCAAGGTAGACAAGAA AGTC (SEQ ID NO: 610) | CCAGAGAGGCCA AAGTACAGTGGA AGGTGGATAACG CCCTCCAATCGG GTAACTCCCAGG AGAGTGTCACAG AGCAGGACAGCA AGGACAGCACCT ACAGCCTCAAGA GCACCCTGACGC TGAGCAAAGCAG ACTACGAGAAAC ACAAAGTCTACG CCTGCGAAGTCA CCCATCAGGGCC TGAGCTCGCCCGT CACAAAGAGCTT CAACAGGGGAGA GTGT (SEQ ID NO: 630) |
| iPS:392526 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC ACATGCAGGGCGTCGCAAAGCATTGGGAGGTCGT TGCATTGGTATCAGCAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT | SEQ ID NO: 629 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | GCAGCCCGAGGATTTCGCGACCTATTACTGTCAC CAGTCATCCAGACTCCCGTTTACTTTTGGCCCTGG GACCAAGGTGGACATTAAGCGTGCTAGTACAAAG GGCCCCTCCGTCTTTCCACTCGCACCCAGTTCAAA GTCCACTTCTGGAGGCACTGCGGCCTTGGGCTGTT TGGTGAAAGACTACTTCCCAGAGCCAGTGACAGT CTCTTGGAATAGCGGAGCACTGACCAGCGGTGTG CATACCTTTCCAGCTGTGCTGCAGAGCAGCGGCC TCTACTCACTGGAGAGTGTCGTCACCGTTCCCTCT TCCAGCCTCGGCACTCAAACTTACATCTGCAACGT GAATCATAAGCCATCTAACACCAAGGTAGACAAG AAAGTC (SEQ ID NO: 611) | |
| iPS:392527 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC ACATGCAGGGCGTCGCAAAGCATTGGGAGGTCGT TGCATTGGTATCAGGAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT GCAGCCCGAGGATTTCGCGACCTATTACTGTCAC CAGTCATCCAGACTCCCGTTTACTTTTGGCCCTGG GACCAAGGTGGACATTAAGCGTGCTAGTACAAAG GGCCCCTCCGTCTTTCCACTCGCACCCAGTTCAAA GTCCACTTCTGGAGGCACTGCGGCCTTGGGCTGTT TGGTGAAAGACTACTTCCCAGAGCCAGTGACAGT CTCTTGGAATAGCGGAGCACTGACCAGCGGTGTG CATACCTTTCCAGCTGTGCTGCAGAGCAGCGGCC TCTACTCACTGGAGAGTGTCGTCACCGTTCCCTCT | SEQ ID NO: 630 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | TCCAGCCTCGGCACTCAAACTTACATCTGCAACGT GAATCATAAGCCATCTAACACCAAGGTAGACAAG AAAGTC (SEQ ID NO: 612) | |
| iPS:392528 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAAAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTAAGCT TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGCAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTACGGTGGCTGCACC ATCTGTCTTCATCTTCCCGCCATCTGATGAGCAGT TGAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGA CAGCACCTACAGCCTCGAAAGCACCCTGACGCTG AGCAAAGCAGACTACGAGAAACACAAAGTCTAC GCCTGCGAAGTCACCCATCAGGGCCTGAGCTCGC CCGTCACAAAGAGCTTCAACAGGGGAGAGTGT (SEQ ID NO: 613) | CAAGTTCAGTTG GTGGAGTCTGGA GCCGAAGTAGTA AAGCCAGGAGCT TCAGTGAAAGTC TCTTGTAAAGCA AGTGGATTCACG TTTAGCCGCTTTG CCATGCATTGGGT GCGGCAAGCTCC CGGTCAGGGGTT GGAGTGGATGGG AGTTATTAGCTAT GACGGGGGCAAT AAGTACTACGCC GAGTCTGTTAAG GGTCGGGTCACA ATGACACGGGAC ACCTCAACCAGT ACACTCTATATGG AACTGTCTAGCCT GAGATCCGAGGA CACCGCTGTGTAT TATTGCGCTAGG GGGTACGATGTA TTGACGGGTTATC CTGATTACTGGG GGCAGGGGACAC TCGTAACCGTCTC TAGTGCCTCCACC AAGGGCCCATCG GTCTTCCCCCTGG CACCCTCCTCCAA GAGCACCTCTGG GGGCACAGCGGC CCTGGGCTGCCTG GTCAAGGACTAC TTCCCCGAACCG GTGACGGTGTCG TGGAACTCAGGC GCCCTGACCAGC GGCGTGCACACC TTCCCGGCTGTCC TACAGTCCTCAG GACTCTACTCCCT CAAGAGCGTGGT GACCGTGCCCTCC AGCAGCTTGGGC ACCCAGACCTAC ATCTGCAACGTG AATCACAAGCCC AGCAACACCAAG GTGGACAAGAAA GTT (SEQ ID NO: 631) |
| iPS:392529 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA | CAAGTTCAGTTG GTGGAGTCTGGA GCCGAAGTAGTA AAGCCAGGAGCT TCAGTGAAAGTC TCTTGTAAAGCA |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAAAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTAAGCT TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGGAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTACGGTGGCTGCACC ATCTGTCTTCATCTTCCCGCCATCTGATGAGCAGT TGAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGA CAGCACCTACAGCCTCGAAAGCACCCTGACGCTG AGCAAAGCAGACTACGAGAAACACAAAGTCTAC GCCTGCGAAGTCACCCATCAGGGCCTGAGCTCGC CCGTCACAAAGAGCTTCAACAGGGGAGAGTGT (SEQ ID NO: 614) | AGTGGATTCACG TTTAGCCGCTTTG CCATGCATTGGGT GCGGAAAGCTCC CGGTCAGGGGTT GGAGTGGATGGG AGTTATTAGCTAT GACGGGGGCAAT AAGTACTACGCC GAGTCTGTTAAG GGTCGGGTCACA ATGACACGGGAC ACCTCAACCAGT ACACTCTATATGG AACTGTCTAGCCT GAGATCCGAGGA CACCGCTGTGTAT TATTGCGCTAGG GGGTACGATGTA TTGACGGGTTATC CTGATTACTGGG GGCAGGGGACAC TCGTAACCGTCTC TAGTGCCTCCACC AAGGGCCCATCG GTCTTCCCCCTGG CACCCTCCTCCAA GAGCACCTCTGG GGGCACAGCGGC CCTGGGCTGCCTG GTCAAGGACTAC TTCCCCGAACCG GTGACGGTGTCG TGGAACTCAGGC GCCCTGACCAGC GGCGTGCACACC TTCCCGGCTGTCC TACAGTCCTCAG GACTCTACTCCCT CAAGAGCGTGGT GACCGTGCCCTCC AGCAGCTTGGGC ACCCAGACCTAC ATCTGCAACGTG AATCACAAGCCC AGCAACACCAAG GTGGACAAGAAA GTT (SEQ ID NO: 632) |
| iPS:392532 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT | SEQ ID NO: 631 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC ACATGCAGGGCGTCGCAAAGCATTGGGAGGTCGT TGCATTGGTATCAGCAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT GCAGCCCGAGGATTTCGCGACCTATTACTGTCAC CAGTCATCCAGACTCCCGTTTACTTTTGGCCCTGG GACCAAGGTGGACATTAAGCGTACGGTGGCTGCA CCATCTGTCTTCATCTTCCCGCCATCTGATGAGCA GTTGAAATCTGGAACTGCCTCTGTTGTGTGCCTGC TGAATAACTTCTATCCCAGAGAGGCCAAAGTACA GTGGAAGGTGGATAACGCCCTCCAATCGGGTAAC TCCCAGGAGAGTGTCACAGAGCAGGACAGCAAG GACAGCACCTACAGCCTCGAAAGCACCCTGACGC TGAGCAAAGCAGACTACGAGAAACACAAAGTCT ACGCCTGCGAAGTCACCCATCAGGGCCTGAGCTC GCCCGTCACAAAGAGCTTCAACAGGGGAGAGTGT (SEQ ID NO: 615) | |
| iPS:392533 | SEQ ID NO: 287 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCCAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG | SEQ ID NO: 632 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC ACATGCAGGGCGTCGCAAAGCATTGGGAGGTCGT TGCATTGGTATCAGGAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT GCAGCCCGAGGATTTCGCGACCTATTACTGTCAC CAGTCATCCAGACTCCCGTTTACTTTTGGCCCTGG GACCAAGGTGGACATTAAGCGTACGGTGGCTGCA CCATCTGTCTTCATCTTCCCGCCATCTGATGAGCA GTTGAAATCTGGAACTGCCTCTGTTGTGTGCCTGC TGAATAACTTCTATCCCAGAGAGGCCAAAGTACA GTGGAAGGTGGATAACGCCCTCCAATCGGGTAAC TCCCAGGAGAGTGTCACAGAGCAGGACAGCAAG GACAGCACCTACAGCCTCGAAAGCACCCTGACGC TGAGCAAAGCAGACTACGAGAAACACAAAGTCT ACGCCTGCGAAGTCACCCATCAGGGCCTGAGCTC GCCCGTCACAAAGAGCTTCAACAGGGGAGAGTGT (SEQ ID NO: 616) | |
| iPS:392530 | CAGTCTGTG TTGACGCAG CCGCCCTCA GTGTCTGCG GCCCCAGGA CAGAAGGTC ACCATCTCC TGCTCTGGA AGCAGCTCC AACATTGGG AATAATTAT GTATCCTGG TACCAGAAG CTCCCAGGA ACAGCCCCC AAACTCCTC ATTTATGAC AATAATAAG CGACCCTCA GGGATTCCT GACCGATTC TCTGGCTCC AAGTCTGGC ACGTCAACC ACCCTGGGC ATCACCGGA CTCCAGACT GGGGACGAG GCCGATTAT TACTGCGGA ACATGGGAT AGCCGCCTG AGTGCTGTG GTTTTCGGC GGAGGGACC AAGCTGACC | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCGAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAAAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT | SEQ ID NO: 631 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | GTCCTAGGT CAGCCCAAG GCCAACCCC ACTGTCACT CTGTTCCCG CCCTCCTCTG AGGAGCTCC AAGCCAACA AGGCCACAC TAGTGTGTC TGATCAGTG ACTTCTACC CGGGAGCTG TGACAGTGG CCTGGAAGG CAGATGGCA GCCCCGTCA AGGCGGGAG TGGAGACCA CCAAACCCT CCAAACAGA GCAACAACA AGTACGCGG CCAAGAGCT ACCTGAGCC TGACGCCCG AGCAGTGGA AGTCCCACA GAAGCTACA GCTGCCAGG TCACGCATG AAGGGAGCA CCGTGGAGA AGACAGTGG CCCCTACAG AATGTTCA (SEQ ID NO: 596) | GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTAAGCT TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGCAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTACGGTGGCTGCACC ATCTGTCTTCATCTTCCCGCCATCTGATGAGCAGT TGAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGA CAGCACCTACAGCCTCGAAAGCACCCTGACGCTG AGCAAAGCAGACTACGAGAAACACAAAGTCTAC GCCTGCGAAGTCACCCATCAGGGCCTGAGCTCGC CCGTCACAAAGAGCTTCAACAGGGGAGAGTGT (SEQ ID NO: 617) | |
| iPS:392531 | SEQ ID NO: 596 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCGAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGATAGTAGTGGTTATTATCACTACAAATAC TACGGTATGGCCGTCTGGGGCCAAGGGACAACAG TTACCGTCTCTAGTGCCTCCACCAAGGGCCCATCG GTCTTCCCCCTGGCACCCTCCTCCAAGAGCACCTC TGGGGGCACAGCGGCCCTGGGCTGCCTGGTCAAG GACTACTTCCCCGAACCGGTGACGGTGTCGTGGA ACTCAGGCGCCCTGACCAGCGGCGTGCACACCTT CCCGGCTGTCCTACAGTCCTCAGGACTCTACTCCC TCGAAAGCGTGGTGACCGTGCCCTCCAGCAGCTT GGGCACCCAGACCTACATCTGCAACGTGAATCAC AAGCCCAGCAACACCAAGGTGGACAAGAAAGTT GAGCCCAAATCTTGTGACAAAACTCACACATGCC CACCGTGCCCAGCACCTGAACTCCTGGGGGGACC GTCAGTCTTCCTCTTCCCCCCAAAACCCAAGGACA CCCTCATGATCTCCCGGACCCCTGAGGTCACATGC GTGGTGGTGGACGTGAGCCACGAAGACCCTGAGG TCAAGTTCAACTGGTACGTGGACGGCGTGGAGGT GCATAATGCCAAGACAAAGCCGTGTGAGGAGCA GTACGGCAGCACGTACCGTTGTGTCAGCGTCCTC ACCGTCCTGCACCAGGACTGGCTGAATGGCAAGG AGTACAAGTGCAAGGTCTCCAACAAAGCCCTCCC AGCCCCCATCGAGAAAACCATCTCCAAAGCCAAA GGGCAGCCCCGAGAACCACAGGTGTACACCCTGC CCCCATCCCGGGAGGAGATGACCAAGAACCAGGT | SEQ ID NO: 632 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | CAGCCTGACCTGCCTGGTCAAAGGCTTCTATCCCA GCGACATCGCCGTGGAGTGGGAGAGCAATGGGC AGCCGGAGAACAACTACAAGACCACGCCTCCCGT GCTGGACTCCGACGGCTCCTTCTTCCTCTATAGCA AGCTCACCGTGGACAAGAGCAGGTGGCAGCAGG GGAACGTCTTCTCATGCTCCGTGATGCATGAGGCT CTGCACAACCACTACACGCAGAAGAGCCTAAGCT TGTCTCCGGGTGGTGGCGGATCGGGAGGTGGCGG ATCCGATATCCAGCTCACTCAATCGCCATCATTTC TCTCCGCTTCGGTAGGCGACCGGGTCACGATCAC ATGCAGGGCGTCGCAAAGCATTGGGAGGTCGTTG CATTGGTATCAGGAGAAACCCGGAAAGGCCCCGA AACTTCTGATCAAATACGCATCACAAAGTTTGAG CGGTGTGCCGTCGCGCTTCTCCGGTTCCGGAAGC GGAACGGAGTTCACGCTTACAATCTCCTCACTGC AGCCCGAGGATTTCGCGACCTATTACTGTCACCA GTCATCCAGACTCCCGTTTACTTTTGGCCCTGGGA CCAAGGTGGACATTAAGCGTACGGTGGCTGCACC ATCTGTCTTCATCTTCCCGCCATCTGATGAGCAGT TGAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGA CAGCACCTACAGCCTCGAAAGCACCCTGACGCTG AGCAAAGCAGACTACGAGAAACACAAAGTCTAC GCCTGCGAAGTCACCCATCAGGGCCTGAGCTCGC CCGTCACAAAGAGCTTCAACAGGGGAGAGTGT (SEQ ID NO: 618) | |
| iPS:392534 | SEQ ID NO: 596 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCGAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC | SEQ ID NO: 631 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | ACATGCAGGGCGTCGCAAAGCATTGGGAGGTCGT TGCATTGGTATCAGCAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT GCAGCCCGAGGATTTCGCGACCTATTACTGTCAC CAGTCATCCAGACTCCCGTTTACTTTTGGCCCTGG GACCAAGGTGGACATTAAGCGTACGGTGGCTGCA CCATCTGTCTTCATCTTCCCGCCATCTGATGAGCA GTTGAAATCTGGAACTGCCTCTGTTGTGTGCCTGC TGAATAACTTCTATCCCAGAGAGGCCAAAGTACA GTGGAAGGTGGATAACGCCCTCCAATCGGGTAAC TCCCAGGAGAGTGTCACAGAGCAGGACAGCAAG GACAGCACCTACAGCCTCGAAAGCACCCTGACGC TGAGCAAAGCAGACTACGAGAAACACAAAGTCT ACGCCTGCGAAGTCACCCATCAGGGCCTGAGCTC GCCCGTCACAAAGAGCTTCAACAGGGGAGAGTGT (SEQ ID NO: 619) | |
| iPS:392535 | SEQ ID NO: 596 | CAGGTGCAGCTGGTGGAATCTGGGGGAGGCGTGG TCCAGCCTGGGAGGTCCCTGAGACTCTCCTGTGC AGCCTCTGGATTCACCTTCAGTAGCTTTGGCATGC ACTGGGTCCGCGAGGCTCCAGGCAAGGGGCTGGA GTGGGTGGCAGTTATATCATTTGATGGAAGTATT AAGTATTCTGTAGACTCCGTGAAGGGCCGATTCA CCATCTCCAGAGACAATTCAAAGAACACGCTGTT TCTGCAAATGAACAGCCTGCGAGCCGAGGACACG GCTGTGTATTACTGTGCGAGAGATCGGCTCAATT ACTATGAAAGTAGTGGTTATTATCACTACAAATA CTACGGTATGGCCGTCTGGGGCCAAGGGACAACA GTTACCGTCTCTAGTGCCTCCACCAAGGGCCCATC GGTCTTCCCCCTGGCACCCTCCTCCAAGAGCACCT CTGGGGGCACAGCGGCCCTGGGCTGCCTGGTCAA GGACTACTTCCCCGAACCGGTGACGGTGTCGTGG AACTCAGGCGCCCTGACCAGCGGCGTGCACACCT TCCCGGCTGTCCTACAGTCCTCAGGACTCTACTCC CTCGAAAGCGTGGTGACCGTGCCCTCCAGCAGCT TGGGCACCCAGACCTACATCTGCAACGTGAATCA CAAGCCCAGCAACACCAAGGTGGACAAGAAAGT TGAGCCCAAATCTTGTGACAAAACTCACACATGC CCACCGTGCCCAGCACCTGAACTCCTGGGGGGAC CGTCAGTCTTCCTCTTCCCCCCAAAACCCAAGGAC ACCCTCATGATCTCCCGGACCCCTGAGGTCACAT GCGTGGTGGTGGACGTGAGCCACGAAGACCCTGA GGTCAAGTTCAACTGGTACGTGGACGGCGTGGAG GTGCATAATGCCAAGACAAAGCCGTGTGAGGAGC AGTACGGCAGCACGTACCGTTGTGTCAGCGTCCT CACCGTCCTGCACCAGGACTGGCTGAATGGCAAG GAGTACAAGTGCAAGGTCTCCAACAAAGCCCTCC CAGCCCCCATCGAGAAAACCATCTCCAAAGCCAA AGGGCAGCCCCGAGAACCACAGGTGTACACCCTG CCCCCATCCCGGGAGGAGATGACCAAGAACCAGG TCAGCCTGACCTGCCTGGTCAAAGGCTTCTATCCC AGCGACATCGCCGTGGAGTGGGAGAGCAATGGG CAGCCGGAGAACAACTACAAGACCACGCCTCCCG TGCTGGACTCCGACGGCTCCTTCTTCCTCTATAGC AAGCTCACCGTGGACAAGAGCAGGTGGCAGCAG GGGAACGTCTTCTCATGCTCCGTGATGCATGAGG CTCTGCACAACCACTACACGCAGAAGAGCCTAAG CTTGTCTCCGGGTGGTGGCGGATCGGGAGGTGGC GGATCCGATATCCAGCTCACTCAATCGCCATCATT TCTCTCCGCTTCGGTAGGCGACCGGGTCACGATC ACATGCAGGGCGTCGCAAAGCATTGGGAGGTCGT TGCATTGGTATCAGGAGAAACCCGGAAAGGCCCC GAAACTTCTGATCAAATACGCATCACAAAGTTTG AGCGGTGTGCCGTCGCGCTTCTCCGGTTCCGGAA GCGGAACGGAGTTCACGCTTACAATCTCCTCACT GCAGCCCGAGGATTTCGCGACCTATTACTGTCAC CAGTCATCCAGACTCCCGTTTACTTTTGGCCCTGG GACCAAGGTGGACATTAAGCGTACGGTGGCTGCA CCATCTGTCTTCATCTTCCCGCCATCTGATGAGCA GTTGAAATCTGGAACTGCCTCTGTTGTGTGCCTGC | SEQ ID NO: 632 |

TABLE 14-continued

Nucleic Acid Sequences of Exemplary Bispecific Antigen Binding Proteins in the IgG-Fab Format

| IgG-Fab Molecule Designation | Light Chain Nucleic Acid Sequence | Modified Heavy Chain Nucleic Acid Sequence | Second Polypeptide Nucleic Acid Sequence |
|---|---|---|---|
| | | TGAATAACTTCTATCCCAGAGAGGCCAAAGTACA GTGGAAGGTGGATAACGCCCTCCAATCGGGTAAC TCCCAGGAGAGTGTCACAGAGCAGGACAGCAAG GACAGCACCTACAGCCTCGAAAGCACCCTGACGC TGAGCAAAGCAGACTACGAGAAACACAAAGTCT ACGCCTGCGAAGTCACCCATCAGGGCCTGAGCTC GCCCGTCACAAAGAGCTTCAACAGGGGAGAGTGT (SEQ ID NO: 620) | |

The nucleic acid sequences provided in Tables 6A, 6B, 7A, 7B, and 11-14 are exemplary only. As will be appreciated by those in the art, due to the degeneracy of the genetic code, an extremely large number of nucleic acids may be made, all of which encode the CDRs (and heavy and light chains or other components of the antigen binding proteins described herein) of the invention. Thus, having identified a particular amino acid sequence, those skilled in the art could make any number of different nucleic acids, by simply modifying the sequence of one or more codons in a way which does not change the amino acid sequence of the encoded protein.

The present invention also includes vectors comprising one or more nucleic acids encoding one or more components of the bispecific antigen binding proteins of the invention (e.g. variable regions, light chains, heavy chains, modified heavy chains, and Fd fragments). The term "vector" refers to any molecule or entity (e.g., nucleic acid, plasmid, bacteriophage or virus) used to transfer protein coding information into a host cell. Examples of vectors include, but are not limited to, plasmids, viral vectors, non-episomal mammalian vectors and expression vectors, for example, recombinant expression vectors. The term "expression vector" or "expression construct" as used herein refers to a recombinant DNA molecule containing a desired coding sequence and appropriate nucleic acid control sequences necessary for the expression of the operably linked coding sequence in a particular host cell. An expression vector can include, but is not limited to, sequences that affect or control transcription, translation, and, if introns are present, affect RNA splicing of a coding region operably linked thereto. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. For instance, in some embodiments, signal peptide sequences may be appended/fused to the amino terminus of any of the polypeptides sequences listed in Tables 6A, 6B, 7A, 7B, 9 and 10. In certain embodiments, a signal peptide having the amino acid sequence of MDMRVPAQLLGLLLLWLRGARC (SEQ ID NO: 633) is fused to the amino terminus of any of the polypeptide sequences in Tables 6A, 6B, 7A, 7B, 9 and 10. In other embodiments, a signal peptide having the amino acid sequence of MAWALLLLTLLTQGTGSWA (SEQ ID NO: 634) is fused to the amino terminus of any of the polypeptide sequences in Tables 6A, 6B, 7A, 7B, 9 and 10. In still other embodiments, a signal peptide having the amino acid sequence of MTCSPLLLTLLIHCTGSWA (SEQ ID NO: 635) is fused to the amino terminus of any of the polypeptide sequences in Tables 6A, 6B, 7A, 7B, 9 and 10. Other suitable signal peptide sequences that can be fused to the amino terminus of the polypeptide sequences described herein include: MEAPAQLLFLLLLWLPDTTG (SEQ ID NO: 636), MEWTWRVLFLVAAATGAHS (SEQ ID NO: 637), METPAQLLFLLLLWLPDTTG (SEQ ID NO: 638), METPAQLLFLLLLWLPDTTG (SEQ ID NO: 639), MKHLWFFLLLLVAAPRWVLS (SEQ ID NO: 640), and MEWSWVFLFFLSVTTGVHS (SEQ ID NO: 641). Other signal peptides are known to those of skill in the art and may be fused to any of the polypeptide chains listed in Tables 6A, 6B, 7A, 7B, 9 and 10, for example, to facilitate or optimize expression in particular host cells.

Typically, expression vectors used in the host cells to produce the bispecific antigen proteins of the invention will contain sequences for plasmid maintenance and for cloning and expression of exogenous nucleotide sequences encoding the components of the bispecific antigen binding proteins. Such sequences, collectively referred to as "flanking sequences," in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the polypeptide coding sequence; the oligonucleotide tag sequence encodes polyHis (such as hexaHis), FLAG, HA (hemaglutinin influenza virus), myc, or another "tag" molecule for which commercially available antibodies exist. This tag is typically fused to the polypeptide upon expression of the polypeptide, and can serve as a means for affinity purification or detection of the polypeptide from the host cell. Affinity purification can be accomplished, for example, by column chromatography using antibodies against the tag as an affinity matrix. Optionally, the tag can subsequently be removed from the purified polypeptide by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors of this invention may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using routine methods for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using known methods for nucleic acid synthesis.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as one or more components of the bispecific antigen binding proteins described herein. As a result, increased quantities of a polypeptide are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed. In certain embodiments, one or more coding regions may be operably linked to an internal ribosome binding site (IRES), allowing translation of two open reading frames from a single RNA transcript.

In some cases, such as where glycosylation is desired in a eukaryotic host cell expression system, one may manipulate the various pre- or prosequences to improve glycosylation or yield. For example, one may alter the peptidase cleavage site of a particular signal peptide, or add prosequences, which also may affect glycosylation. The final protein product may have, in the −1 position (relative to the first amino acid of the mature protein) one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors of the invention will typically contain a promoter that is recognized by the host organism and operably linked to the molecule encoding the polypeptide. The term "operably linked" as used herein refers to the linkage of two or more nucleic acid sequences in such a manner that a nucleic acid molecule capable of directing the transcription of a given gene and/or the synthesis of a desired protein molecule is produced. For example, a control sequence in a vector that is "operably linked" to a protein coding sequence is ligated thereto so that expression of the protein coding sequence is achieved under conditions compatible with the transcriptional activity of the control sequences. More specifically, a promoter and/or enhancer sequence, including any combination of cis-acting transcriptional control elements is operably linked to a coding sequence if it stimulates or modulates the transcription of the coding sequence in an appropriate host cell or other expression system.

Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding e.g., heavy chain, light chain, modified heavy chain, or other component of the bispecific antigen binding proteins of the invention, by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus and most preferably Simian Virus 40 (SV40). Other suitable mammalian promoters include heterologous mammalian promoters, for example, heat-shock promoters and the actin promoter.

Additional promoters which may be of interest include, but are not limited to: SV40 early promoter (Benoist and Chambon, 1981, Nature 290:304-310); CMV promoter (Thornsen et al., 1984, Proc. Natl. Acad. U.S.A. 81:659-663); the promoter contained in the 3' long terminal repeat of Rous sarcoma virus (Yamamoto et al., 1980, Cell 22:787-797); herpes thymidine kinase promoter (Wagner et al., 1981, Proc. Natl. Acad. Sci. U.S.A. 78: 1444-1445); promoter and regulatory sequences from the metallothionine gene Prinster et al., 1982, Nature 296:39-42); and prokaryotic promoters such as the beta-lactamase promoter (Villa-Kamaroff et al., 1978, Proc. Natl. Acad. Sci. U.S.A. 75:3727-3731); or the tac promoter (DeBoer et al., 1983, Proc. Natl. Acad. Sci. U.S.A. 80:21-25). Also of interest are the following animal transcriptional control regions, which exhibit tissue specificity and have been utilized in transgenic animals: the elastase I gene control region that is active in pancreatic acinar cells (Swift et al., 1984, Cell 38:639-646; Ornitz et al., 1986, Cold Spring Harbor Symp. Quant. Biol. 50:399-409; MacDonald, 1987, Hepatology 7:425-515); the insulin gene control region that is active in pancreatic beta cells (Hanahan, 1985, Nature 315: 115-122); the immunoglobulin gene control region that is active in lymphoid cells (Grosschedl et al., 1984, Cell 38:647-658; Adames et al., 1985, Nature 318:533-538; Alexander et al., 1987, Mol. Cell. Biol. 7: 1436-1444); the mouse mammary tumor virus control region that is active in testicular, breast, lymphoid and mast cells (Leder et al., 1986, Cell 45:485-495); the albumin gene control region that is active in liver (Pinkert et al., 1987, Genes and Devel. 1:268-276); the alpha-feto-protein gene control region that is active in liver (Krumlauf et al., 1985, Mol. Cell. Biol. 5: 1639-1648; Hammer et al., 1987, Science 253:53-58); the alpha 1-antitrypsin gene control region that is active in liver (Kelsey et al., 1987, Genes and Devel. 1: 161-171); the beta-globin gene control region that is active in myeloid cells (Mogram et al, 1985, Nature 315:338-340; Kollias et al, 1986, Cell 46:89-94); the myelin basic protein gene control region that is active in oligodendrocyte cells in the brain (Readhead et al., 1987, Cell 48:703-712); the myosin light chain-2 gene control region that is active in skeletal muscle (Sani, 1985, Nature 314:283-286); and the gonadotropic releasing hormone gene control region that is active in the hypothalamus (Mason et al., 1986, Science 234: 1372-1378).

An enhancer sequence may be inserted into the vector to increase transcription of DNA encoding a component of the bispecific antigen binding proteins (e.g., light chain, heavy chain, modified heavy chain, Fd fragment) by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides are described above. Other signal peptides that are functional in mammalian host cells include the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art. The expression vectors can be introduced into host cells to thereby produce proteins, including fusion proteins, encoded by nucleic acids as described herein.

In certain embodiments, nucleic acids encoding the different components of the bispecific antigen binding proteins of the invention may be inserted into the same expression vector. For instance, the nucleic acid encoding an anti-PAC1 receptor light chain can be cloned into the same vector as the nucleic acid encoding an anti-PAC1 receptor heavy chain. In such embodiments, the two nucleic acids may be separated by an internal ribosome entry site (IRES) and under the control of a single promoter such that the light chain and heavy chain are expressed from the same mRNA transcript. Alternatively, the two nucleic acids may be under the control of two separate promoters such that the light chain and heavy chain are expressed from two separate mRNA transcripts. In some embodiments, nucleic acids encoding the anti-PAC1 receptor light chain and heavy chain are cloned into one expression vector and the nucleic acids encoding the anti-CGRP receptor light chain and heavy chain are cloned into a second expression vector.

Similarly, for IgG-scFv bispecific antigen binding proteins, the nucleic acid encoding the light chain may be cloned into the same expression vector as the nucleic acid encoding the modified heavy chain (fusion protein comprising the heavy chain and scFv) where the two nucleic acids are under the control of a single promoter and separated by an IRES or where the two nucleic acids are under the control of two separate promoters. For IgG-Fab bispecific antigen binding proteins, nucleic acids encoding each of the three components may be cloned into the same expression vector. In some embodiments, the nucleic acid encoding the light chain of the IgG-Fab molecule and the nucleic acid encoding the second polypeptide (which comprises the other half of the C-terminal Fab domain) are cloned into one expression vector, whereas the nucleic acid encoding the modified heavy chain (fusion protein comprising a heavy chain and half of a Fab domain) is cloned into a second expression vector. In certain embodiments, all components of the bispecific antigen binding proteins described herein are expressed from the same host cell population. For example, even if one or more components is cloned into a separate expression vector, the host cell is co-transfected with both expression vectors such that one cell produces all components of the bispecific antigen binding proteins.

After the vector has been constructed and the one or more nucleic acid molecules encoding the components of the bispecific antigen binding proteins described herein has been inserted into the proper site(s) of the vector or vectors, the completed vector(s) may be inserted into a suitable host cell for amplification and/or polypeptide expression. Thus, the present invention encompasses an isolated host cell comprising one or more expression vectors encoding the components of the bispecific antigen binding proteins. The term "host cell" as used herein refers to a cell that has been transformed, or is capable of being transformed, with a nucleic acid and thereby expresses a gene of interest. The term includes the progeny of the parent cell, whether or not the progeny is identical in morphology or in genetic make-up to the original parent cell, so long as the gene of interest is present. A host cell that comprises an isolated nucleic acid of the invention, preferably operably linked to at least one expression control sequence (e.g. promoter or enhancer), is a "recombinant host cell."

The transformation of an expression vector for an antigen binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Exemplary host cells include prokaryote, yeast, or higher eukaryote cells. Prokaryotic host cells include eubacteria, such as Gram-negative or Gram-positive organisms, for example, Enterobacteriaceae such as Escherichia, e.g., E. coli, Enterobacter, Erwinia, Klebsiella, Proteus, Salmonella, e.g., Salmonella typhimurium, Serratia, e.g., Serratia marcescans, and Shigella, as well as Bacillus, such as B. subtilis and B. licheniformis, Pseudomonas, and Streptomyces. Eukaryotic microbes such as filamentous fungi or yeast are suitable cloning or expression hosts for recombinant polypeptides. Saccharomyces cerevisiae, or common baker's yeast, is the most commonly used among lower eukaryotic host microorganisms. However, a number of other genera, species, and strains are commonly available and useful herein, such as Pichia, e.g. P. pastoris, Schizosaccharomyces pombe; Kluyveromyces, Yarrowia; Candida; Trichoderma reesia; Neurospora crassa; Schwanniomyces, such as Schwanniomyces occidentalis; and filamentous fungi, such as, e.g., Neurospora, Penicillium, Tolypocladium, and Aspergillus hosts such as A. nidulans and A. niger.

Host cells for the expression of glycosylated antigen binding proteins can be derived from multicellular organisms. Examples of invertebrate cells include plant and insect cells. Numerous baculoviral strains and variants and corresponding permissive insect host cells from hosts such as Spodoptera frugiperda (caterpillar), Aedes aegypti (mosquito), Aedes albopictus (mosquito), Drosophila melanogaster (fruitfly), and Bombyx mori have been identified. A variety of viral strains for transfection of such cells are publicly available, e.g., the L-1 variant of Autographa californica NPV and the Bm-5 strain of Bombyx mori NPV.

Vertebrate host cells are also suitable hosts, and recombinant production of antigen binding proteins from such cells has become routine procedure. Mammalian cell lines available as hosts for expression are well known in the art and include, but are not limited to, immortalized cell lines available from the American Type Culture Collection (ATCC), including but not limited to Chinese hamster ovary (CHO) cells, including CHOK1 cells (ATCC CCL61), DXB-11, DG-44, and Chinese hamster ovary cells/-DHFR (CHO, Urlaub et al., Proc. Natl. Acad. Sci. USA 77: 4216, 1980); monkey kidney CV1 line transformed by SV40 (COS-7, ATCC CRL 1651); human embryonic kidney line (293 or 293 cells subcloned for growth in suspension culture, (Graham et al., J. Gen Virol. 36: 59, 1977); baby hamster kidney cells (BHK, ATCC CCL 10); mouse sertoli cells (TM4, Mather, Biol. Reprod. 23: 243-251, 1980); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human hepatoma cells (Hep G2, HB 8065); mouse mammary tumor (MMT 060562, ATCC CCL51); TRI cells (Mather et al., Annals N.Y Acad. Sci. 383: 44-68, 1982); MRC 5 cells or FS4 cells; mammalian myeloma cells, and a number of other cell lines. In certain embodiments, cell lines may be selected through determining which cell lines have high expression levels and constitutively produce bispecific antigen binding proteins with CGRP receptor and PAC1 receptor binding properties. In another embodiment, a cell line from the B cell lineage that does not make its own antibody but has a capacity to make and secrete a heterologous antibody can be selected. CHO cells are preferred host cells in some embodiments for expressing the bispecific antigen binding proteins of the invention.

Host cells are transformed or transfected with the above-described nucleic acids or vectors for production of bispecific antigen binding proteins and are cultured in conventional nutrient media modified as appropriate for inducing promoters, selecting transformants, or amplifying the genes encoding the desired sequences. In addition, novel vectors and transfected cell lines with multiple copies of transcription units separated by a selective marker are particularly useful for the expression of antigen binding proteins. Thus, the present invention also provides a method for preparing a bispecific antigen binding protein described herein comprising culturing a host cell comprising one or more expression vectors described herein in a culture medium under conditions permitting expression of the bispecific antigen binding protein encoded by the one or more expression vectors; and recovering the bispecific antigen binding protein from the culture medium.

The host cells used to produce the antigen binding proteins of the invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., Meth. Enz. 58: 44, 1979; Barnes et al., Anal. Biochem. 102: 255, 1980; U.S. Pat. Nos. 4,767,704; 4,657,866; 4,927,762; 4,560,655; or 5,122,469; WO90103430; WO 87/00195; or U.S. Pat. Re. No. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

Upon culturing the host cells, the bispecific antigen binding protein can be produced intracellularly, in the periplasmic space, or directly secreted into the medium. If the antigen binding protein is produced intracellularly, as a first step, the particulate debris, either host cells or lysed fragments, is removed, for example, by centrifugation or ultrafiltration. The bispecifc antigen binding protein can be purified using, for example, hydroxyapatite chromatography, cation or anion exchange chromatography, or preferably affinity chromatography, using the antigen(s) of interest or protein A or protein G as an affinity ligand. Protein A can be used to purify proteins that include polypeptides that are based on human γ1, γ2, or γ4 heavy chains (Lindmark et al., J. Immunol. Meth. 62: 1-13, 1983). Protein G is recommended for all mouse isotypes and for human γ3 (Guss et al., EMBO J. 5: 15671575, 1986). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the protein comprises a CH3 domain, the Bakerbond ABX™ resin (J. T. Baker, Phillipsburg, N.J.) is useful for purification. Other techniques for protein purification such as ethanol precipitation, Reverse Phase HPLC, chromatofocusing, SDS-PAGE, and ammonium sulfate precipitation are also possible depending on the particular bispecific antigen binding protein to be recovered.

In some embodiments, the invention provides a pharmaceutical composition comprising one or a plurality of the bispecific antigen binding proteins of the invention together with pharmaceutically acceptable diluents, carriers, excipients, solubilizers, emulsifiers, preservatives, and/or adjuvants. Pharmaceutical compositions of the invention include, but are not limited to, liquid, frozen, and lyophilized compositions. "Pharmaceutically-acceptable" refers to molecules, compounds, and compositions that are non-toxic to human recipients at the dosages and concentrations employed and/or do not produce allergic or adverse reactions when administered to humans. In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. Methods and suitable materials for formulating molecules for therapeutic use are known in the pharmaceutical arts, and are described, for example, in REMINGTON'S PHARMACEUTICAL SCIENCES, 18th Edition, (A. R. Genrmo, ed.), 1990, Mack Publishing Company.

In some embodiments, the pharmaceutical composition of the invention comprises a standard pharmaceutical carrier, such as a sterile phosphate buffered saline solution, bacteriostatic water, and the like. A variety of aqueous carriers may be used, e.g., water, buffered water, 0.4% saline, 0.3% glycine and the like, and may include other proteins for enhanced stability, such as albumin, lipoprotein, globulin, etc., subjected to mild chemical modifications or the like.

Exemplary concentrations of the bispecific antigen binding proteins in the formulation may range from about 0.1 mg/ml to about 180 mg/ml or from about 0.1 mg/mL to about 50 mg/mL, or from about 0.5 mg/mL to about 25 mg/mL, or alternatively from about 2 mg/mL to about 10 mg/mL. An aqueous formulation of the antigen binding protein may be prepared in a pH-buffered solution, for example, at pH ranging from about 4.5 to about 6.5, or from about 4.8 to about 5.5, or alternatively about 5.0. Examples of buffers that are suitable for a pH within this range include acetate (e.g. sodium acetate), succinate (such as sodium succinate), gluconate, histidine, citrate and other organic acid buffers. The buffer concentration can be from about 1 mM to about 200 mM, or from about 10 mM to about 60 mM, depending, for example, on the buffer and the desired isotonicity of the formulation.

A tonicity agent, which may also stabilize the antigen binding protein, may be included in the formulation. Exemplary tonicity agents include polyols, such as mannitol, sucrose or trehalose. Preferably the aqueous formulation is isotonic, although hypertonic or hypotonic solutions may be suitable. Exemplary concentrations of the polyol in the formulation may range from about 1% to about 15% w/v.

A surfactant may also be added to the antigen binding protein formulation to reduce aggregation of the formulated antigen binding protein and/or minimize the formation of particulates in the formulation and/or reduce adsorption. Exemplary surfactants include nonionic surfactants such as polysorbates (e.g. polysorbate 20 or polysorbate 80) or poloxamers (e.g. poloxamer 188). Exemplary concentrations of surfactant may range from about 0.001% to about 0.5%, or from about 0.005% to about 0.2%, or alternatively from about 0.004% to about 0.01% w/v.

In one embodiment, the formulation contains the above-identified agents (i.e. antigen binding protein, buffer, polyol and surfactant) and is essentially free of one or more preservatives, such as benzyl alcohol, phenol, m-cresol, chlorobutanol and benzethonium chloride. In another embodiment, a preservative may be included in the formulation, e.g., at concentrations ranging from about 0.1% to about 2%, or alternatively from about 0.5% to about 1%. One or more other pharmaceutically acceptable carriers, excipients or stabilizers such as those described in Remington's Pharmaceutical Sciences 16th edition, Osol, A. Ed. (1980) may be included in the formulation provided that they do not adversely affect the desired characteristics of the formulation.

Therapeutic formulations of the bispecific antigen binding protein are prepared for storage by mixing the bispecific antigen binding protein having the desired degree of purity with optional physiologically acceptable carriers, excipients or stabilizers (Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, maltose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

In one embodiment, a suitable formulation of the claimed invention contains an isotonic buffer such as a phosphate, acetate, or TRIS buffer in combination with a tonicity agent, such as a polyol, sorbitol, sucrose or sodium chloride, which tonicifies and stabilizes. One example of such a tonicity agent is 5% sorbitol or sucrose. In addition, the formulation could optionally include a surfactant at 0.01% to 0.02% wt/vol, for example, to prevent aggregation or improve stability. The pH of the formulation may range from 4.5-6.5 or 4.5 to 5.5. Other exemplary descriptions of pharmaceutical formulations for antigen binding proteins may be found in US 2003/0113316 and U.S. Pat. No. 6,171,586, each incorporated herein by reference in its entirety.

The formulation herein may also contain more than one active compound as necessary for the particular indication being treated, preferably those with complementary activities that do not adversely affect each other. For example, it may be desirable to further provide an immunosuppressive agent. Such molecules are suitably present in combination in amounts that are effective for the purpose intended.

The active ingredients may also be entrapped in microcapsule prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Suspensions and crystal forms of antigen binding proteins are also contemplated. Methods to make suspensions and crystal forms are known to one of skill in the art.

The formulations to be used for in vivo administration must be sterile. The compositions of the invention may be sterilized by conventional, well known sterilization techniques. For example, sterilization is readily accomplished by filtration through sterile filtration membranes. The resulting solutions may be packaged for use or filtered under aseptic conditions and lyophilized, the lyophilized preparation being combined with a sterile solution prior to administration.

The process of freeze-drying is often employed to stabilize polypeptides for long-term storage, particularly when the polypeptide is relatively unstable in liquid compositions. A lyophilization cycle is usually composed of three steps: freezing, primary drying, and secondary drying (see Williams and Polli, Journal of Parenteral Science and Technology, Volume 38, Number 2, pages 48-59, 1984). In the freezing step, the solution is cooled until it is adequately frozen. Bulk water in the solution forms ice at this stage. The ice sublimes in the primary drying stage, which is conducted by reducing chamber pressure below the vapor pressure of the ice, using a vacuum. Finally, sorbed or bound water is removed at the secondary drying stage under reduced chamber pressure and an elevated shelf temperature. The process produces a material known as a lyophilized cake. Thereafter the cake can be reconstituted prior to use.

The standard reconstitution practice for lyophilized material is to add back a volume of pure water (typically equivalent to the volume removed during lyophilization), although dilute solutions of antibacterial agents are sometimes used in the production of pharmaceuticals for parenteral administration (see Chen, Drug Development and Industrial Pharmacy, Volume 18: 1311-1354, 1992).

Excipients have been noted in some cases to act as stabilizers for freeze-dried products (see Carpenter et al., Volume 74: 225-239, 1991). For example, known excipients include polyols (including mannitol, sorbitol and glycerol);

sugars (including glucose and sucrose); and amino acids (including alanine, glycine and glutamic acid).

In addition, polyols and sugars are also often used to protect polypeptides from freezing and drying-induced damage and to enhance the stability during storage in the dried state. In general, sugars, in particular disaccharides, are effective in both the freeze-drying process and during storage. Other classes of molecules, including mono- and disaccharides and polymers such as PVP, have also been reported as stabilizers of lyophilized products.

For injection, the pharmaceutical formulation and/or medicament may be a powder suitable for reconstitution with an appropriate solution as described above. Examples of these include, but are not limited to, freeze dried, rotary dried or spray dried powders, amorphous powders, granules, precipitates, or particulates. For injection, the formulations may optionally contain stabilizers, pH modifiers, surfactants, bioavailability modifiers and combinations of these.

Sustained-release preparations may be prepared. Suitable examples of sustained-release preparations include semipermeable matrices of solid hydrophobic polymers containing the bispecific antigen binding protein, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and y ethyl-L-glutamate, non-degradable ethylene-vinyl acetate, degradable lactic acid-glycolic acid copolymers such as the Lupron Depot™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated polypeptides remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

The formulations of the invention may be designed to be short-acting, fast-releasing, long-acting, or sustained-releasing as described herein. Thus, the pharmaceutical formulations may also be formulated for controlled release or for slow release.

Specific dosages may be adjusted depending on conditions of disease, the age, body weight, general health conditions, sex, and diet of the subject, dose intervals, administration routes, excretion rate, and combinations of drugs. Any of the above dosage forms containing effective amounts are well within the bounds of routine experimentation and therefore, well within the scope of the instant invention.

The bispecific antigen binding protein is administered by any suitable means, including parenteral, subcutaneous, intraperitoneal, intrapulmonary, and intranasal, and, if desired for local treatment, intralesional administration. Parenteral infusions include intravenous, intraarterial, intraperitoneal, intramuscular, intradermal or subcutaneous administration. In addition, the bispecific antigen binding protein is suitably administered by pulse infusion, particularly with declining doses of the antigen binding protein. Preferably the dosing is given by injections, most preferably intravenous or subcutaneous injections, depending in part on whether the administration is brief or chronic. Other administration methods are contemplated, including topical, particularly transdermal, transmucosal, rectal, oral or local administration e.g. through a catheter placed close to the desired site. Most preferably, the antigen binding protein of the invention is administered intravenously in a physiological solution at a dose ranging between 0.01 mg/kg to 100 mg/kg at a frequency ranging from daily to weekly to monthly (e.g. every day, every other day, every third day, or 2, 3, 4, 5, or 6 times per week), preferably a dose ranging from 0.1 to 45 mg/kg, 0.1 to 15 mg/kg or 0.1 to 10 mg/kg at a frequency of once per week, once every two weeks, or once a month.

The bispecific antigen binding proteins described herein are useful for treating or ameliorating a condition associated with CGRP receptor and/or PAC1 receptor in a patient in need thereof. As used herein, the term "treating" or "treatment" is an intervention performed with the intention of preventing the development or altering the pathology of a disorder.

Accordingly, "treatment" refers to both therapeutic treatment and prophylactic or preventative measures. Those in need of treatment include those already diagnosed with or suffering from the disorder or condition as well as those in which the disorder or condition is to be prevented. "Treatment" includes any indicia of success in the amelioration of an injury, pathology or condition, including any objective or subjective parameter such as abatement, remission, diminishing of symptoms, or making the injury, pathology or condition more tolerable to the patient, slowing in the rate of degeneration or decline, making the final point of degeneration less debilitating, or improving a patient's physical or mental well-being. The treatment or amelioration of symptoms can be based on objective or subjective parameters, including the results of a physical examination, self-reporting by a patient, neuropsychiatric exams, and/or a psychiatric evaluation.

Accordingly, in some embodiments, the present invention provides a method for treating or preventing a condition associated with CGRP receptor and/or PAC1 receptor in a patient in need thereof, comprising administering to the patient an effective amount of a bispecific antigen binding protein described herein. The term "patient" includes human patients. An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with a particular condition (e.g. chronic pain, headache or migraine). In some embodiments, the effective amount is a therapeutically effective amount or a prophylactically effective amount. A "therapeutically effective amount" is an amount sufficient to remedy a disease state (e.g., a headache, migraine, or chronic pain) or symptom(s), particularly a state or symptom(s) associated with the disease state, or otherwise prevent, hinder, retard or reverse the progression of the disease state or any other undesirable symptom associated with the disease in any way whatsoever (i.e. that provides "therapeutic efficacy"). A "prophylactically effective amount" is an amount of a pharmaceutical composition that, when administered to a subject, will have the intended prophylactic effect, e.g., preventing or delaying the onset (or reoccurrence) of the condition (e.g. headache or migraine), or reducing the likelihood of the onset (or reoccurrence) of the condition (e.g. headache, migraine, or headache symptoms). The full therapeutic or prophylactic effect does not necessarily occur by administration of one dose, and may occur only after administration of a series of doses. Thus, a therapeutically or prophylactically effective amount may be administered in one or more administrations.

In certain embodiments, the present invention provides a method for treating or ameliorating headache, particularly migraine headache, in a patient in need thereof comprising administering to the patient an effective amount of a bispecific antigen binding protein described herein. Migraine headaches are recurrent headaches lasting about 4 to about 72 hours that are characterized by unilateral, pulsating, and/or moderate to severe pain and/or pain that is exacerbated by physical activity. Migraine headaches are often accompanied by nausea, vomiting, and/or sensitivity to light (photophobia), sound (phonophobia), or smell. In some patients, an aura precedes the onset of the migraine headache. The aura is typically a visual, sensory, language, or motor disturbance that signals the headache will soon occur. The methods described herein prevent, treat, or ameliorate one or more symptoms of migraine headaches with and without aura in human patients.

Activation of the CGRP receptor and PAC1 receptor by their respective ligands induce vasodilation, particularly vasodilation of the dura vasculature. Both receptor signaling cascades have been implicated in migraine pathophysiology, and are believed to contribute to the induction of migraine through different, but related mechanisms. CGRP released as a result of activation of the trigeminovascular system not only induces vasodilation of the cranial vessels, but also contributes to the induction of neurogenic inflammation, which is a form of inflammation secondary to sensory nerve activation. See, e.g., Bigal et al., Headache, Vol. 53(8):1230-44, 2013, which is hereby incorporated by reference. CGRP also acts as a neurotransmitter to transmit pain signals from the brainstem to the thalamus. While CGRP acts through the sensory system, the PAC1 receptor and its PACAP ligand operate through the parasympathetic division of the autonomic nervous system. Immunohistochemistry studies in cynomolgus monkey mapped PACAP and PAC1 localization to the parasympathetic pathway through the sphenopalatine ganglion (SPG; also known as pterygopalatine ganglion), which also innervates the dura vasculature (data not shown). The parasympathetic pathway is independent and parallel to the sensory pathway that also controls the dura vasculature tone. Infusion of the PAC1 receptor agonist PACAP causes migraine-like headache in migraine patients, suggesting that blocking PAC1 may be useful for treating migraine (Schytz et al., Brain 132:16-25, 2009).

Additional experiments performed in support of the present invention showed that a selective PAC1 antibody blocked electrically stimulated trigeminal cervical complex (TCC) activation, an electrophysiology model that has been reported to correlate with clinical migraine efficacy (data not shown). In some embodiments, the bispecific antigen binding proteins described herein have an additive or synergistic effect in treating migraine headache (e.g. reducing the frequency, duration, or severity of migraine headache) as compared to the treatment effect obtained with either an anti-CGRP receptor antagonist or an anti-PAC1 receptor antagonist alone. Without being bound by theory, it is believed that inhibiting both the CGRP receptor and the PAC1 receptor with the bispecific antigen binding proteins of the invention will provide greater efficacy in treating migraine headache than antagonizing either target alone.

In some embodiments, the patients to be treated according to the methods of the invention have, suffer from, or are diagnosed with episodic migraine. Episodic migraine is diagnosed when patients with a history of migraine (e.g. at least five lifetime attacks of migraine headache) have 14 or fewer migraine headache days per month. A "migraine headache day" includes any calendar day during which a patient experiences the onset, continuation, or recurrence of a "migraine headache" with or without aura lasting greater than 30 minutes. A "migraine headache" is a headache associated with nausea or vomiting or sensitivity to light or sound and/or a headache characterized by at least two of the following pain features: unilateral pain, throbbing pain, moderate to severe pain intensity, or pain exacerbated by physical activity.

In certain embodiments, patients having, suffering from, or diagnosed with episodic migraine have at least four, but less than 15 migraine headache days per month on average. In related embodiments, patients having, suffering from, or diagnosed with episodic migraine have fewer than 15 headache days per month on average. As used herein, a "headache day" is any calendar day in which the patient experiences a migraine headache as defined herein or any headache that lasts greater than 30 minutes or requires acute headache treatment.

In certain embodiments, the patients to be treated according to the methods of the invention have, suffer from, or are diagnosed with chronic migraine. Chronic migraine is diagnosed when migraine patients (i.e. patients with at least five lifetime attacks of migraine headache) have 15 or more headache days per month and at least 8 of the headache days are migraine headache days. In some embodiments, patients having, suffering from, or diagnosed with chronic migraine have 15 or more migraine headache days per month on average. In certain embodiments of the methods described herein, administration of a bispecific antigen binding protein of the invention prevents, reduces, or delays the progression of episodic migraine in the patient to chronic migraine.

In other embodiments, the present invention provides a method for treating or ameliorating cluster headache in a patient in need thereof comprising administering to the patient an effective amount of a bispecific antigen binding protein described herein. Cluster headache is a condition that involves, as its most prominent feature, recurrent, severe headaches on one side of the head, typically around the eye (see Nesbitt et al., BMJ, Vol. 344:e2407, 2012). Some doctors and scientists have described the pain resulting from cluster headaches as the most intense pain a human can endure—worse than giving birth, burns or broken bones. Cluster headaches often occur periodically: spontaneous remissions interrupt active periods of pain. Cluster headaches are often accompanied by cranial autonomic symptoms, such as tearing, nasal congestion, ptosis, pupil constriction, facial blushing, sweating, and swelling around the eye, often confined to the side of the head with the pain. The average age of onset of cluster headache is ~30-50 years. It is more prevalent in males with a male to female ratio of about 2.5:1 to about 3.5:1. Sphenopalatine ganglion (SPG) stimulation has been used for the treatment of cluster headache. A neurostimulation system, which delivers low-level (but high frequency, physiologic-blocking) electrical stimulation to the SPG, has demonstrated efficacy in relieving the acute debilitating pain of cluster headache in a recent clinical trial (see Schoenen J, et al., Cephalalgia, Vol. 33(10):816-30, 2013). In view of this evidence and because PACAP is one of the major neurotransmitters in SPG, inhibition of PAC1 receptor signaling with a bispecific antigen binding protein described herein is expected to have efficacy in treating cluster headache in humans.

Other conditions associated with CGRP receptor and/or PAC1 receptor signaling that may be treated according to the methods of the invention include, but are not limited to, chronic pain syndromes, such as arthritic pain (e.g. osteoarthritis and rheumatoid arthritis), neurogenic inflammation, tension-type headaches, hemiplegic migraine, retinal migraine, and vasomotor symptoms (e.g. hot flashes, facial flushing, sweating, and night sweats), such as those associate with menopause. In one embodiment, the condition is chronic pain. CGRP may be involved in chronic pain syndromes other than migraine. In rodents, intrathecally-delivered CGRP induces severe pain, and CGRP levels are enhanced in a number of pain models. In addition, CGRP antagonists partially block nociception in acute pancreatitis in rodents (see Wick et al. Surgery, Volume 139: 197-201, 2006). In any of the methods described herein, the treatment can comprise prophylactic treatment. Prophylactic treatment refers to treatment designed to be taken before the onset of a condition or an attack (e.g. before a migraine attack or onset of a cluster headache episode) to reduce the frequency, severity, and/or length of the symptoms (e.g. migraine or cluster headaches) in the patient.

The bispecific antigen binding proteins of the invention are useful for detecting CGRP receptor and/or PAC1 receptor in biological samples and identification of cells or tissues that express the CGRP receptor and/or PAC1 receptor. For instance, the bispecific antigen binding proteins can be used in diagnostic assays, e.g., binding assays to detect and/or quantify CGRP receptor and/or PAC1 receptor expressed in a tissue or cell. In addition, the bispecific antigen binding proteins described herein can be used to inhibit CGRP receptor from forming a complex with its ligand CGRP, thereby modulating the biological activity of CGRP receptor in a cell or tissue. Likewise, the bispecific antigen binding proteins described herein can be used to inhibit PAC1 receptor from forming a complex with its ligand PACAP, thereby modulating the biological activity of PAC1 receptor in a cell or tissue. Examples of activities that can be modulated include, but are not limited to, inhibiting vasodilation and/or reducing neurogenic inflammation.

The bispecific antigen binding proteins described herein can be used for diagnostic purposes to detect, diagnose, or monitor diseases and/or conditions associated with the CGRP receptor and/or the PAC1 receptor. Also provided are methods for the detection of the presence of CGRP receptor or PAC1 receptor in a sample using classical immunohistological methods known to those of skill in the art (e.g., Tijssen, 1993, Practice and Theory of Enzyme Immunoassays, Vol 15 (Eds R. H. Burdon and P. H. van Knippenberg, Elsevier, Amsterdam); Zola, 1987, Monoclonal Antibodies: A Manual of Techniques, pp. 147-158 (CRC Press, Inc.); Jalkanen et al., 1985, J. Cell. Biol. 101:976-985; Jalkanen et al., 1987, J. Cell Biol. 105:3087-3096). The detection of either receptor (CGRP receptor or PAC1 receptor) can be performed in vivo or in vitro.

Diagnostic applications provided herein include use of the antigen binding proteins to detect expression of CGRP receptor and/or PAC1 receptor and binding of the ligands to either receptor. Examples of methods useful in the detection of the presence of the receptor include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, 3-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used.

In another embodiment, the bispecific antigen binding protein described herein can be used to identify a cell or cells that express CGRP receptor and/or PAC1 receptor. In a specific embodiment, the antigen binding protein is labeled with a labeling group and the binding of the labeled antigen binding protein to CGRP receptor and/or PAC1 receptor is detected. In a further specific embodiment, the binding of the antigen binding protein to CGRP receptor and/or PAC1 receptor is detected in vivo. In a further specific embodiment, the bispecific antigen binding protein is isolated and measured using techniques known in the art. See, for example, Harlow and Lane, 1988, Antibodies: A Laboratory Manual, New York: Cold Spring Harbor (ed. 1991 and periodic supplements); John E. Coligan, ed., 1993, Current Protocols In Immunology New York: John Wiley & Sons.

Another aspect provides for detecting the presence of a test molecule that competes for binding to CGRP receptor and/or PAC1 receptor with the antigen binding proteins described herein. An example of one such assay would involve detecting the amount of free antigen binding protein in a solution containing an amount of CGRP receptor and/or PAC1 receptor in the presence or absence of the test molecule. An increase in the amount of free antigen binding protein (i.e., the antigen binding protein not bound to CGRP receptor and/or PAC1 receptor) would indicate that the test molecule is capable of competing for CGRP receptor and/or PAC1 receptor binding with the bispecific antigen binding protein. In one embodiment, the antigen binding protein is labeled with a labeling group. Alternatively, the test molecule is labeled and the amount of free test molecule is monitored in the presence and absence of the antigen binding protein.

The following are additional embodiments of the invention for exemplary purposes, and are not intended to be limiting in any way:

Embodiment 1

A bispecific antigen binding protein that specifically binds to human CGRP receptor and human PAC1.

Embodiment 2

The bispecific antigen binding protein of Embodiment 1, wherein the antigen binding protein is an antibody or an antibody fragment.

Embodiment 3

The bispecific antigen binding protein of Embodiments 1-2, wherein the antigen binding protein is an antibody, or antibody fragment, comprising all four of the variable domains found in an antibody selected from the antibodies designated iPS:326417, iPS:326626, iPS:326628, iPS:

326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, and iPS:328051, as set forth herein.

Embodiment 4

The bispecific antigen binding protein of Embodiments 1-3, wherein the antigen binding protein is an antibody: (a) selected from the antibodies designated iPS:326417, iPS:326626, iPS:326628, iPS:326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, and iPS:328051, as set forth herein, or (b) an antibody from (a) comprising an immunoglobulin light chain or immunoglobulin heavy chain from which one, two, three, four or five amino acid residues are lacking from the N-terminal or C-terminal of said light chain or heavy chain, or both.

Embodiment 5

The bispecific antigen binding protein of Embodiments 1-4, wherein the antigen binding protein is an antibody fragment selected from a Fab, a Fab', a F(ab')$_2$, a Fv, a Fd, a domain antibody (dAb), a complementarity determining region (CDR) fragment, a single-chain antibody (scFv), a single chain antibody fragment, a maxibody, a diabody, a triabody, a tetrabody, a minibody, a linear antibody, a chelating recombinant antibody, an intrabody, a nanobody, a small modular immunopharmaceutical (SMIP), an antigen-binding-domain immunoglobulin fusion protein, and a camelized antibody.

Embodiment 6

The bispecific antigen binding protein of Embodiments 1-5, comprising constant regions of the IgG1, IgG2, IgG3, or IgG4 immunoglobulin isotype.

Embodiment 7

The bispecific antigen binding protein of Embodiments 1-6, comprising all twelve complementarity determining regions (CDRs) of an antibody selected from the antibodies designated iPS:326417, iPS:326626, iPS:326628, iPS:326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, and iPS:328051, as set forth herein.

Embodiment 8

The bispecific antigen binding protein of Embodiments 1-6, comprising: (a) all six complementarity determining regions (CDRs) that specifically bind CGRP receptor of an antibody selected from the antibodies designated iPS:326417, iPS:326626, iPS:326628, iPS:326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, and iPS:328051, as set forth herein; and (b) all six CDRs that specifically bind PAC1 from a different antibody selected from the antibodies designated iPS:326417, iPS:326626, iPS:326628, iPS:326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, and iPS:328051, as set forth herein.

Embodiment 9

The bispecific antigen binding protein of Embodiments 7-8, wherein one or more of the CDRs of the antigen binding protein contains a conservative amino acid substitution.

Embodiment 10

The bispecific antigen binding protein of Embodiments 1-9, comprising a modification that reduces or eliminates effector function.

Embodiment 11

A pharmaceutical composition comprising the antigen binding protein of any of Embodiments 1-10, and a pharmaceutically acceptable diluent, excipient or carrier.

Embodiment 12

A recombinant host cell that expresses the bispecific antigen binding protein of any of Embodiments 1-10.

Embodiment 13

The recombinant host cell of Embodiment 12, wherein the cell is a CHO cell.

Embodiment 14

A method for treating a condition associated with CGRP receptor or PAC1, or both, in a patient, comprising administering to a patient an effective amount of the bispecific antigen binding protein of any of Embodiments 1-10.

Embodiment 15

The method of Embodiment 14, wherein the condition is headache.

Embodiment 16

The method of Embodiment 15, wherein the condition is a cluster headache.

Embodiment 17

The method of Embodiment 15, wherein the condition is migraine.

Embodiment 18

The method of Embodiment 17, wherein the migraine is episodic migraine.

Embodiment 19

The method of Embodiment 17, wherein the migraine is chronic migraine.

Embodiment 20

The method of Embodiment 14, wherein the condition is chronic pain.

Embodiment 21

The method of any of Embodiments 14-20, wherein the method comprises prophylactic treatment.

The following examples, including the experiments conducted and the results achieved, are provided for illustrative purposes only and are not to be construed as limiting the scope of the appended claims.

Examples

Example 1. Engineering of CGRP Receptor and PAC1 Receptor Antibodies to Improve Stability, Biophysical Properties, and Expression, and Eliminate Chemical Hotspots Starting Antibodies
Generation and Screening of Anti-CGRP Receptor Antibodies.

Monoclonal anti-human CGRP receptor antibodies were generated and sequenced as described in Examples 1-3 of WO2010/075238 (Human CGRP Receptor Binding Proteins), which is hereby incorporated by reference in its entirety. Briefly, human CRLR cDNA (GenBank Accession No. U17473) and RAMP1 cDNA (GenBank Accession No. AJ001014) were cloned into the mammalian cell expression vectors pcDNA3.1-Zeo and pcDNA3.1-Hyg (Invitrogen, Carlsbad, Calif.), respectively, for transfections of HEK 293EBNA cells (Invitrogen). The hCRLR cDNA and hRAMP1 cDNA were also cloned into the pDSRa24 vector (Kim, H. Y. et al. J. Inv. Derm. Symp. Proc. (2007) 12: 48-49) for transfections of AM-1 CHO cells (U.S. Pat. No. 6,210,924). Stable transfectants expressing CGRPR were identified.

XENOMOUSE® animals were immunized with purified soluble CGRP receptor protein and purified CGRP receptor membranes prepared from AM-1 CHO cells stably expressing CGRP receptor, using doses of 10 Gg/mouse and 150 Gg/mouse, respectively. Subsequent boosts were administered at doses of 10 Gg/mouse of soluble CGRP receptor or 75 μg of purified CGRP receptor membranes. XENOMOUSE® animals were also immunized with CGRP receptor-expressing cells using doses of $3.4 \times 10^6$ CGRP receptor-transfected cells per mouse and subsequent boosts were of $1.7 \times 10^6$ CGRP receptor-transfected cells per mouse. Injection sites used were combinations of subcutaneous, base-of-tail, and intraperitoneal. Immunizations were performed in accordance with methods disclosed in U.S. Pat. No. 7,064,244, the disclosure of which is hereby incorporated by reference. Adjuvants TiterMax Gold (Sigma; cat. # T2684), Alum (E.M. Sergent Pulp and Chemical Co., Clifton, N.J., cat. #1452-250) were prepared according to manufacturers' instructions and mixed in a 1:1 ratio of adjuvant emulsion to antigen solution. Sera were collected 4-6 weeks after the first injection and specific titers were determined by FACs staining of recombinant CGRP receptor-expressing 293EBNA cells. Mice were immunized with either cells or membranes from cells expressing full length CGRP receptor, or soluble CGRP receptor extracellular domain, with a range of 11-17 immunizations over a period of approximately one to three and one-half months. Mice with the highest sera titer were identified and prepared for hybridoma generation. The immunizations were performed in groups of multiple mice, typically ten. Popliteal and inguinal lymph nodes and spleen tissues were typically pooled from each group for generating hybridomas. Hybridoma supernatants were screened for CGRP receptor-specific monoclonal antibodies by Fluorometric Microvolume Assay Technology (FMAT) (Applied Biosystems, Foster City, Calif.). The supernatants were screened against either the AM-1 CHO huCGRP receptor cells or recombinant HEK 293 cells that were transfected with human CGRP receptor and counter-screened against parental HEK293 cells. Anti-CGRP receptor antibodies were sequenced using standard RT-PCR methods, as described in Examples 2-3 of WO2010/075238 (Human CGRP Receptor Binding Proteins).

Generation and Screening of Anti-PAC1 Receptor Antibodies.

Monoclonal anti-human PAC1 receptor antibodies were generated and sequenced as described in WO2014/144632 (Human PAC1 Antibodies), which is hereby incorporated by reference in its entirety. Briefly, antibodies were generated through immunization of XENOMOUSE® animals with the PAC1 extracellular domain protein (DNA tagged with a T-cell epitope tag), L1.2 cells expressing full-length human PAC1, or other human PAC1 antigens using standard methods, e.g., such as those detailed in US Patent Publication No. 2010/0172895. Hybridoma supernatants were screened for binding to PAC1 receptor as well as for functional antagonist activity in an assay detecting their ability to block generation of cAMP by activation of PAC1 with either PACAP (e.g., PACAP-27 or PACAP-38) or a selective, exogenous peptide ligand (Maxadilan), and then counter-screened against the related receptors VPAC1 and VPAC2. Those supernatants with desirable function and selectivity were sequenced and cloned, expressed recombinantly, purified, and tested again for function and selectivity using standard methods. Selected human PAC1 receptor antibodies were screened in an in vitro PAC1-mediated cAMP assay to determine intrinsic potency. The assay employed cell lines expressing human PAC1 (SH-SY-5Y, a human neuroblastoma cell line endogenously expressing PAC1), cynomolgus PAC i1, rat PAC i1, human VPAC1 and human VPAC2. The LANCE cAMP assay kit (PerkinElmer, Boston, Mass.) was used in the screening. The assays were performed in white 96-well plates in a total volume of 60 µL. Briefly, on the day of the assay, the frozen cells were thawed at 37° C., cells were washed once with assay buffer and 12 µL of cell suspension containing 10,000 cells mixed with Alexa-labeled anti-cAMP antibody was added into 96 half-area white plates. After adding 12 µL PAC1 antibody, the mixture was incubated for 30 min at room temperature. Then 12 µL PAC1 agonist PACAP-38 (1 nM final concentration) was added and further incubated for 15 min at room temperature. After agonist stimulation, 24 µL of detection mix was added and incubated for 60 minutes at room temperature and the plates were read on EnVision instrument (PerkinElmer, Boston, Mass.) at an emission wavelength of 665 nM. Data were processed and analyzed by Prizm (GraphPad Software Inc.) or ActivityBase (IDBS).

Engineering to Improve Biophysical Properties

Of the monoclonal antibodies generated and screened as described above, a subset of the anti-CGRP receptor antibodies and anti-human PAC1 receptor antibodies were identified for bispecific antibody generation and for engineering to improve biophysical properties.

Two antibodies were selected for optimization during the PAC1 antibody engineering. These antibodies resulted from the novel CDR grafting exercise to improve sequence diversity, stability, and expression. However, the other PAC1 receptor antibodies and all of the CGRP receptor antibodies did not go through the optimization engineering process. However, these antibodies were analyzed for potential chemical hotspots and covariance violations. It has been shown in numerous projects that fixing the covariance violations improves the thermal stability, expression and biophysical properties of the antibodies. See, e.g., WO2012/125495. Co-variance analysis was conducted of the selected anti-CGRP receptor and anti-PAC1 receptor antibodies according to the methods described in WO2012/125495.

Example 2. Generation of CGRP Receptor/PAC1 Receptor Hetero Immunoglobulins

Generation of a bispecific antibody through co-expression of two different antibodies leads to contaminants. The preferred bispecific, heterotetramer molecule with two different heavy chains associated with correctly paired light chains is only a minority of the total amount of combinations expressed. The contaminants occur mainly due to two different reasons. The first reason is that the heavy chain that comes together at the Fc region of the antibody can homodimerize, leading to conventional monospecific antibody, or heterodimerize, leading to bispecific antibody. The second reason is that light chain is promiscuous and can pair with either of the heavy chains, leading to mispaired light-heavy chain Fab assembly that may not retain the activity and binding to the desired target. Hence, the bispecific engineering is a two-step process. The first goal is to prevent the homodimerization of the heavy chains and encourage heterodimerization. This can be achieved through engineering the Fc region of the antibodies, using, for example, the knobs-into-holes or charge pair mutations strategies. The second goal is to engineer the light-heavy chain interface in such a way that the light chain is specifically associated only with its cognate heavy chain.

The "Hetero-Ig" platform technology (see, e.g., WO2009089004 and WO2014081955, both of which are hereby incorporated by reference in their entireties) takes advantage of the electrostatic steering mechanism to overcome the two problems mentioned above. Specifically, charged residues are introduced or exploited to drive heavy chain heterodimerization and light-heavy chain association. The charge pair mutations (CPMs) in the CH3 domain of the Fc region drive the heterodimerization of the two different heavy chains through opposite charges that cause electrostatic attraction (see, e.g., WO2009089004 and U.S. Pat. No. 8,592,562); the two identical heavy chain combinations have identical charges and are therefore repelled. The correct heavy chain-light chain pairing is facilitated by CPMs at the CH1/CL binding interface (see FIG. 1; "v1" & "v4") or between the VH/VL and CH1/CL binding interfaces (see FIG. 1; "v3"). The correct heavy chain-light chain combinations will have opposite charges and therefore be attracted to each other, whereas the incorrect heavy chain-light chain combinations will have the same charges and be repelled. As a result, the correctly assembled hetero-Ig will have either three ("v1") or four CPMs ("v3" and "v4") that drive the assembly of the preferred heterotetramer comprising two different heavy chains and two different light chains so that the heterotetramer will be the majority component generated by the expression system.

Because the CGRP receptor and PAC1 receptor targets are expressed on cell surfaces, there is a risk of in vivo platelet depletion by antagonizing either target. Thus, the effector functionless IgG1 scaffold (see, e.g., U.S. Patent Publication No. 2014/0343252, which is hereby incorporated by reference in its entirety) was chosen as the framework for the generation of the bispecific hetero Ig molecules. The effector functionless scaffold includes an IgG1 variant with a N297G mutation to knock out the glycosylation in the CH2 domain and an engineered disulfide bond introduced in the CH2 domain to improve the stability in the absence of glycosylation. The lack of glycosylation in the CH2 domain resulting from the N297G mutation leads to significantly reduced binding to Fc gamma receptors, which helps address the platelet depletion issue. See, e.g., Example 5 of WO2014/144632.

Six anti-PAC1 receptor antibodies (antibodies 01 to 06 as described herein) and nine anti-CGRP receptor engineered antibodies (antibodies 50 to 58 as described herein), with their co-variance violations corrected, were utilized to generate 169 distinct bispecific hetero Ig molecules using high throughput cloning, expression and purification. Each of the bispecific hetero Ig molecules had one of the three formats shown in FIG. 1 using the IgG1 effector functionless scaffold or an IgG2 scaffold. The sequences of each of the 169 bispecific hetero immunoglobulins are set forth in Table 8.

Example 3. Functional Activity of Bispecific Hetero Immunoglobulin Molecules

The bispecific hetero Ig molecules generated as described in Example 2 were tested for their ability to inhibit ligand-induced activation of the human CGRP receptor and the human PAC1 receptor using in vitro cAMP assays as described in detail below.

CGRP Receptor Activity Assay.

The assay employed a human neuroblastoma-derived cell line (SK-N-MC; Spengler, et al., (1973) In Vitro 8: 410) obtained from ATCC (ATCC Number HTB-10; "HTB-10 cells"). HTB-10 cells express human CRLR and human RAMP1, which form the human CGRP receptor (McLatchie et al., (1998) Nature, 393:333-339).

The LANCE Ultra cAMP assay kit (PerkinElmer, Boston, Mass.) was used. The assays were performed in white 96-well plates in a total volume of 40 μL. Briefly, on the day of the assay, the frozen HTB-10 cells were thawed at 37° C. and were washed once with assay buffer. 10 L of cell suspension containing 1000 cells was added into 96 half-area white plates. After adding 5 μL of the bispecific hetero IgG (single point or 10 points dose response curve: final concentration ranges from 1 μM to 0.5 μM), the mixture was incubated for 30 min at room temperature. Then, 5 μL CGRP receptor agonist human α-CGRP (3 nM final concentration) was added and further incubated for 15 min at room temperature. After human α-CGRP stimulation, L of detection mix was added and incubated for 45 minutes at room temperature and the plates were read on EnVision instrument (PerkinElmer, Boston, Mass.) at an emission wavelength of 665 nm. Data were processed and analyzed by Prizm (GraphPad Software Inc.).

PAC1 Receptor Activity Assay.

The assay employed a human neuroblastoma-derived cell line (SH-SH5Y; Biedler J L, et al., Cancer Res. 38: 3751-3757, 1978) obtained from ATCC (ATCC Number CRL-2266; "CRL-2266 cells"). CRL-2266 cells express human PAC1 receptor (Monaghan et al., J Neurochem. 104(1): 74-88, 2008).

The LANCE Ultra cAMP assay kit (PerkinElmer, Boston, Mass.) was used. The assays were performed in white 96-well plates in a total volume of 40 μL. Briefly, on the day of the assay, the frozen CRL-2266 cells were thawed at 37° C. and were washed once with assay buffer. 10 μL of cell suspension containing 2000 cells was added into 96 half-area white plates. After adding 5 μL of the bispecific hetero IgG (single point or 10 point dose response curve: concentration ranges from 1 μM to 0.5 μM), the mixture was incubated for 30 min at room temperature. Then, 5 μL PAC1 receptor agonist human PACAP38 (10 pM final concentration) was added and the mixture was further incubated for 15 min at room temperature. After human PACAP38 stimulation, 20 μL of detection mix was added and incubated for 45 minutes at room temperature and the plates were read on EnVision instrument (PerkinElmer, Boston, Mass.) at emission wavelength 665 nm. Data were processed and analyzed by Prizm (GraphPad Software Inc.).

Percentage inhibition of CGRP receptor and PAC1 receptor activities for each of the 169 bispecific hetero IgGs are shown in Table 15 below. IC50 values were calculated for a subset of the bispecific hetero IgGs based on a 10 point dose response curve. These IC50 values are shown below in Table 16.

TABLE 15

Percentage inhibition of human CGRP receptor and human PAC1 receptor activity by bispecific hetero IgGs (n = 1)

| Bispecific Hetero IgG Designation | % inhibition of human CGRPR | % inhibition of human PAC1 | Bispecific Hetero IgG Designation | % inhibition of human CGRPR | % inhibition of human PAC1 |
|---|---|---|---|---|---|
| iPS:326417 | 66 | 48 | iPS:326651 | 66 | 23 |
| iPS:326626 | 96 | 86 | iPS:326654 | 79 | 99 |
| iPS:326628 | 84 | 61 | iPS:328000 | 75 | 63 |
| iPS:326631 | 89 | 79 | iPS:328001 | 65 | 95 |
| iPS:326634 | 66 | 43 | iPS:326661 | 77 | 72 |
| iPS:327870 | 67 | 86 | iPS:326663 | 64 | 62 |
| iPS:327871 | 65 | 68 | iPS:326666 | 74 | 15 |
| iPS:326645 | 67 | 59 | iPS:326669 | 74 | 85 |
| iPS:326648 | 73 | 92 | iPS:327017 | 67 | 27 |
| iPS:327018 | 68 | 17 | iPS:327026 | 81 | 78 |
| iPS:327019 | 65 | 79 | iPS:327091 | 65 | 67 |
| iPS:327023 | 74 | 32 | iPS:327092 | 73 | 52 |
| iPS:327024 | 75 | 7 | iPS:327093 | 70 | 68 |
| iPS:327025 | 76 | 21 | iPS:327094 | 73 | 91 |
| iPS:326414 | 70 | 58 | iPS:327106 | 71 | 6 |
| iPS:327102 | 74 | 47 | iPS:327107 | 76 | 22 |
| iPS:327103 | 82 | 21 | iPS:327108 | 66 | 74 |
| iPS:327104 | 81 | 95 | iPS:327109 | 73 | 82 |
| iPS:327105 | 81 | 63 | iPS:327110 | 80 | 71 |
| iPS:327111 | 88 | 65 | iPS:327270 | 71 | 82 |
| iPS:327112 | 84 | 104 | iPS:327272 | 81 | 62 |
| iPS:327267 | 75 | 29 | iPS:327273 | 81 | 10 |
| iPS:327268 | 79 | 38 | iPS:327274 | 87 | 22 |
| iPS:327269 | 79 | 8 | iPS:327275 | 85 | 86 |
| iPS:327276 | 80 | 87 | iPS:327282 | 87 | 58 |
| iPS:327277 | 83 | 56 | iPS:327283 | 85 | 99 |
| iPS:327278 | 85 | 47 | iPS:327284 | 77 | 25 |
| iPS:327279 | 73 | 95 | iPS:327285 | 84 | 9 |
| iPS:327280 | 80 | 83 | iPS:327286 | 85 | 23 |
| iPS:327281 | 82 | 50 | iPS:327287 | 86 | 71 |
| iPS:327288 | 67 | 88 | iPS:327679 | 86 | 23 |
| iPS:327289 | 72 | 75 | iPS:327680 | 88 | 92 |
| iPS:327290 | 70 | 60 | iPS:327681 | 72 | 73 |
| iPS:327291 | 70 | 89 | iPS:327682 | 75 | 12 |
| iPS:327677 | 81 | 43 | iPS:327683 | 70 | 30 |
| iPS:327678 | 84 | 43 | iPS:327684 | 71 | 74 |
| iPS:327685 | 86 | 85 | iPS:327689 | 78 | 86 |
| iPS:327686 | 87 | 69 | iPS:327690 | 80 | 50 |
| iPS:327687 | 91 | 62 | iPS:327691 | 73 | 25 |
| iPS:327688 | 89 | 103 | iPS:327693 | 76 | 82 |
| iPS:327694 | 87 | 75 | iPS:327705 | 88 | 56 |

TABLE 15-continued

Percentage inhibition of human CGRP receptor and human PAC1 receptor activity by bispecific hetero IgGs (n = 1)

| Bispecific Hetero IgG Designation | % inhibition of human CGRPR | % inhibition of human PAC1 | Bispecific Hetero IgG Designation | % inhibition of human CGRPR | % inhibition of human PAC1 |
|---|---|---|---|---|---|
| iPS:327696 | 87 | 10 | iPS:327706 | 87 | 103 |
| iPS:327697 | 88 | 39 | iPS:327707 | 73 | 72 |
| iPS:327698 | 90 | 96 | iPS:327708 | 79 | 18 |
| iPS:327699 | 72 | 92 | iPS:327709 | 82 | 29 |
| iPS:327700 | 77 | 72 | iPS:327710 | 82 | 61 |
| iPS:327701 | 73 | 41 | iPS:327711 | 87 | 97 |
| iPS:327702 | 79 | 86 | iPS:327712 | 89 | 81 |
| iPS:327703 | 83 | 87 | iPS:327713 | 89 | 85 |
| iPS:327704 | 82 | 71 | iPS:327714 | 94 | 104 |
| iPS:327717 | 92 | 94 | iPS:327729 | 84 | 85 |
| iPS:327718 | 78 | 70 | iPS:327730 | 87 | 101 |
| iPS:327719 | 85 | 59 | iPS:327731 | 74 | 74 |
| iPS:327721 | 81 | 99 | iPS:327732 | 69 | 56 |
| iPS:327722 | 82 | 38 | iPS:327733 | 84 | 66 |
| iPS:327724 | 80 | 33 | iPS:327734 | 82 | 99 |
| iPS:327725 | 86 | 39 | iPS:327735 | 81 | 68 |
| iPS:327726 | 91 | 77 | iPS:327736 | 88 | 20 |
| iPS:327727 | 93 | 93 | iPS:327737 | 82 | 54 |
| iPS:327728 | 80 | 79 | iPS:327738 | 85 | 93 |
| iPS:327739 | 79 | 76 | iPS:327875 | 83 | 10 |
| iPS:327740 | 74 | 58 | iPS:327876 | 77 | 11 |
| iPS:327741 | 83 | 70 | iPS:327877 | 72 | 22 |
| iPS:327742 | 84 | 96 | iPS:327878 | 75 | 42 |
| iPS:327872 | 80 | 40 | iPS:327879 | 81 | 19 |
| iPS:327874 | 95 | 5 | iPS:327880 | 87 | 15 |
| iPS:327881 | 76 | 16 | iPS:327891 | 80 | 78 |
| iPS:327882 | 83 | 13 | iPS:327892 | 88 | 33 |
| iPS:327883 | 77 | 27 | iPS:327893 | 74 | 56 |
| iPS:327884 | 78 | 8 | iPS:327894 | 80 | 12 |
| iPS:327885 | 73 | 7 | iPS:327895 | 80 | 15 |
| iPS:327886 | 72 | 65 | iPS:327896 | 87 | 28 |
| iPS:327887 | 87 | 35 | iPS:327897 | 80 | 12 |
| iPS:327888 | 83 | 56 | iPS:328031 | 75 | 27 |
| iPS:327889 | 83 | 9 | iPS:328033 | 82 | 20 |
| iPS:327890 | 94 | 15 | iPS:328034 | 86 | 9 |
| iPS:328035 | 73 | 10 | iPS:328041 | 82 | 17 |
| iPS:328036 | 79 | 21 | iPS:328042 | 85 | 20 |
| iPS:328037 | 71 | 25 | iPS:328043 | 75 | 8 |
| iPS:328038 | 69 | 6 | iPS:328044 | 77 | 5 |
| iPS:328039 | 74 | 9 | iPS:328045 | 67 | 29 |
| iPS:328040 | 74 | 70 | iPS:328046 | 73 | 3 |
| iPS:328047 | 78 | 33 | iPS:328050 | 80 | 11 |
| iPS:328048 | 69 | 9 | iPS:328051 | 77 | 21 |
| iPS:328049 | 92 | 13 | | | |

TABLE 16

Inhibitory activity of bispecific hetero IgGs against the human CGRP receptor and human PAC1 receptor (n = 5, except where noted)

| Bispecific Hetero IgG Designation | Human CGRP Receptor IC50 (nM) ± SD | Human PAC1 Receptor IC50 (nM) ± SD |
|---|---|---|
| iPS:326648 | 2.6 ± 0.8 | 2.7 ± 0.8 |
| iPS:327026 | 5.5 (n = 1) | 5.4 (n = 1) |
| iPS:327111 | 2.2 ± 0.8 | 19.4 ± 5.0 |
| iPS:327112 | 10.1 (n = 1) | 13.6 (n = 1) |
| iPS:327270 | 1.9 ± 0.55 | 16.2 ± 4.2 |
| iPS:327272 | 1.2 ± 0.7 | 48.7 ± 14.2 |
| iPS:327283 | 12.9 (n = 1) | 2.1 (n = 1) |
| iPS:327680 | 2.0 ± 0.6 | 11.6 ± 4.3 |
| iPS:327688 | 8.2 (n = 1) | 7.1 (n = 1) |
| iPS:327689 | 1.0 ± 0.5 | 13.6 ± 4.2 |
| iPS:327698 | 1.6 ± 0.7 | 14.5 ± 2.0 |
| iPS:327702 | 1.4 ± 0.48 | 6.7 ± 0.2 |
| iPS:327714 | 9.1 (n = 1) | 2.6 (n = 1) |
| iPS:327717 | 1.8 ± 0.76 | 20.2 ± 5.3 |
| iPS:327730 | 2.6 ± 1.3 | 12.2 ± 2.9 |
| iPS:327741 | 1.9 ± 0.8 | 107.5 ± 30.5 |
| iPS:327742 | 1.4 ± 0.6 | 11.1 ± 3.5 |
| iPS:328001 | 2.5 ± 1.1 | 2.8 ± 1.0 |

Example 4. Synthesis and Activity of CGRP Receptor/PAC1 Receptor IgG-scFv Bispecific Antigen Binding Proteins A subset of the anti-CGRP receptor and anti-PAC1 receptor antibodies described in Example 1 were used to design bispecific antigen binding proteins having an IgG-scFv format. In this format, a single-chain variable fragment (scFv) containing heavy and light chain variable domains from a first antibody is fused through a peptide linker to the carboxyl-terminus of the heavy chain of a second antibody to form a modified heavy chain (see FIG. 2). The light chain from the second antibody is expressed with the modified heavy chain. Assembly of the full molecule creates a tetravalent binding protein having two antigen binding domains against a first target located on the amino terminal side of a dimerized immunoglobulin Fc region and two antigen binding domains against a second target located on the carboxyl terminal side of the dimerized Fc region.

The CGRPR/PAC1 IgG-scFv contains two antigen binding domains, one directed against CGRP receptor and the other against PAC1 receptor. The DNA molecules encoding CGRPR-PAC1 IgG-scFv molecules contain fragments coding for an anti-CGRPR (or anti-PAC1 receptor) antibody heavy chain (HC) in which the C-terminus is fused to an anti-PAC1 receptor (or anti-CGRP receptor) single chain variable fragment (scFv) with or without cysteine clamp, and an anti-CGRP receptor (or anti-PAC1 receptor) antibody light chain (LC). In order to introduce the cysteine clamp, which can improve stability, position 44 (Kabat numbering) in the VH region and position 100 (Kabat numbering) in the VL region were mutated to cysteine. The DNA molecules were generated by synthesized gBlocks and cloned into a pTT5.1 vector. These expression vectors were used to transfect and express the CGRPR/PAC1 bispecific molecules in human 293-6E cells. Thirty different IgG-scFv bispecific molecules were generated. The full sequences for each molecule are set forth in Table 9.

The IgG-scFv molecules were tested for their ability to inhibit ligand-induced activation of the human CGRP receptor and the human PAC1 receptor using in vitro cAMP assays as described in Example 3. IC50 values for each of the molecules for each target receptor are shown in Table 17 below.

TABLE 17

Inhibitory activity of bispecific IgG-scFv molecules against the human CGRP receptor and human PAC1 receptor

| Bispecific IgG-scFv Designation | Human CGRP Receptor IC50 (nM) | Human PAC1 Receptor IC50 (nM) |
|---|---|---|
| iPS:386705 | 0.43 | 605.28 |
| iPS:386707 | 0.47 | 739.75 |
| iPS:386709 | 0.47 | 431.70 |
| iPS:386711 | 0.53 | 1211.80 |
| iPS:386713 | 0.37 | 603.02 |
| iPS:386725 | 0.42 | 548.93 |
| iPS:386727 | 0.72 | 371.35 |
| iPS:386729 | 0.47 | 565.33 |
| iPS:386731 | 0.40 | 346.93 |
| iPS:386733 | 0.34 | 74.33 |
| iPS:386736 | 0.90 | 5.43 |
| iPS:386738 | 0.74 | 5.09 |
| iPS:386740 | 0.56 | 4.40 |
| iPS:386742 | 0.61 | 6.39 |
| iPS:386744 | 0.61 | 3.63 |
| iPS:386746 | 0.79 | 3.28 |
| iPS:386748 | 0.63 | 2.85 |
| iPS:386750 | 0.58 | 4.54 |
| iPS:386752 | 0.62 | 6.08 |
| iPS:386754 | 0.54 | 5.74 |
| iPS:386756 | 1.88 | 7.29 |
| iPS:386758 | 2.32 | 4.11 |
| iPS:386760 | 2.11 | 4.67 |
| iPS:386762 | 2.80 | 3.55 |
| iPS:386764 | 2.61 | 11.88 |
| iPS:386715 | 0.43 | 688.60 |
| iPS:386717 | 0.33 | 580.08 |
| iPS:386719 | 0.41 | 940.48 |

TABLE 17-continued

Inhibitory activity of bispecific IgG-scFv molecules against the human CGRP receptor and human PAC1 receptor

| Bispecific IgG-scFv Designation | Human CGRP Receptor IC50 (nM) | Human PAC1 Receptor IC50 (nM) |
|---|---|---|
| iPS:386721 | 0.22 | 197.13 |
| iPS:386723 | 0.27 | 248.18 |

All bispecific IgG-scFv molecules tested exhibited inhibitory activity against both human CGRP receptor and human PAC1 receptor. Interestingly, the molecules that were the more potent inhibitors of the PAC1 receptor (e.g., iPS:386736, iPS:386738, iPS:386740, iPS:386742, iPS:386744, iPS:386746, iPS:386748, iPS:386750, iPS:386752, iPS:386754, iPS:386756, iPS:386758, iPS:386760, iPS:386762, and iPS:386764) were those in which the PAC1 receptor binding domain was located at the amino terminus of the Fc region. Generally, in this format, the CGRP receptor binding domain could be located on either side of the Fc region without substantially affecting inhibitory potency.

Example 5. Synthesis and Activity of CGRP Receptor/PAC1 Receptor IgG-Fab Bispecific Antigen Binding Proteins Additional bispecific antigen binding proteins were prepared with a subset of the anti-CGRP receptor and anti-PAC1 receptor antibodies described in Example 1 using a third format.

Figure 3:
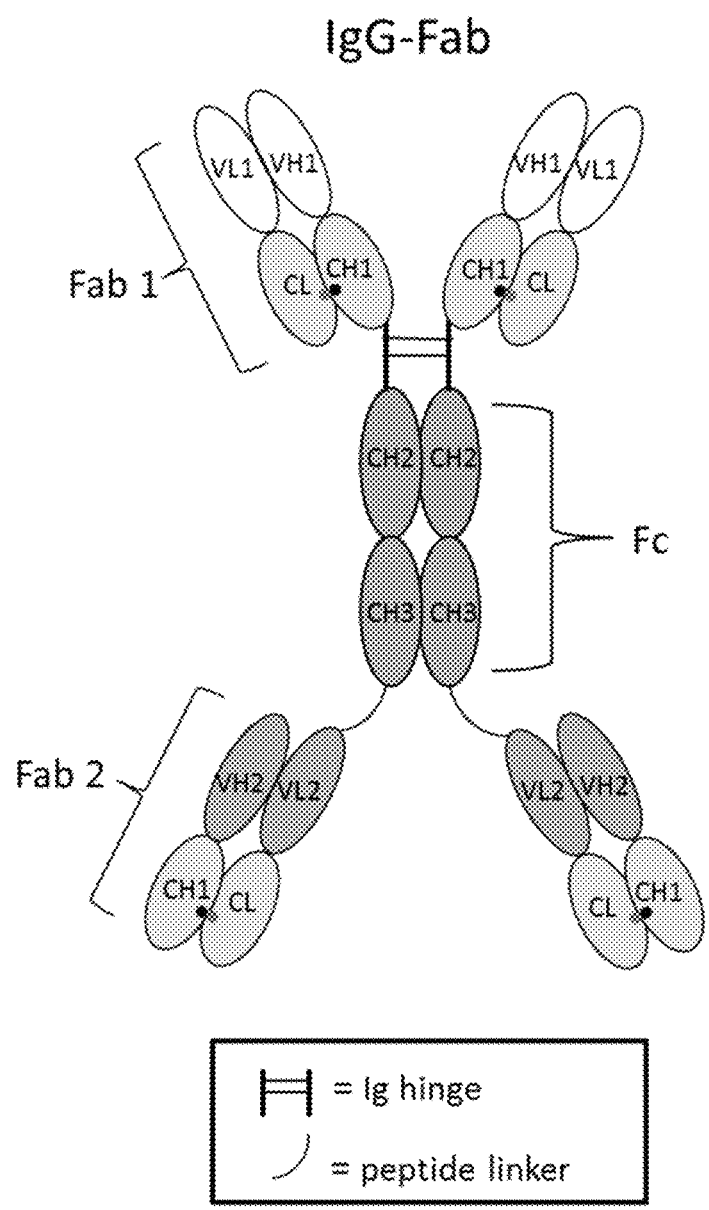
FIG. 3 depicts a schematic representation of an IgG-Fab format used to generate anti-CGRP receptor/PAC1 receptor bispecific antigen binding proteins. In this format, one polypeptide chain of a Fab fragment from a second antibody (e.g. the light chain (VL2-CL)) is fused to the carboxyl terminus of the heavy chain of a first antibody through a peptide linker to produce a modified heavy chain. The complete molecule is homohexamer comprising two modified heavy chains, two light chains from the first antibody, and two polypeptide chains containing the other half of the Fab fragment from the second antibody (e.g. the Fd chain (VH2-CH1)). Charge pair mutations (represented by the circles) can be introduced into the Fab regions of the first antibody (Fab 1) or second antibody (Fab 2) to promote correct heavy chain-light chain pairs. Although the light chain of the second antibody is shown as the fusion partner for the heavy chain of the first antibody in the schematic, the Fd region (VH-CH1) of the second antibody can be fused to the carboxyl terminus of the heavy chain with the light chain of the second antibody completing the Fab domain at the carboxyl terminus of the Fc region.

In some embodiments of this IgG-Fab format, a polypeptide comprising either VL-CL domains or VH-CH1 domains from a first antibody is fused through a peptide linker to the carboxyl-terminus of the heavy chain of a second antibody to form a modified heavy chain (see FIG. 3).

A second polypeptide comprising the remaining domains of the Fab fragment from the first antibody (i.e. VH-CH1 domains or VL-CL domains) is co-expressed with the light chain of the second antibody and the modified heavy chain to produce the complete molecule. Similar to the IgG-scFv format, assembly of the full molecule creates a tetravalent binding protein having two antigen binding domains against a first target located on the amino terminal side of a dimerized immunoglobulin Fc region and two antigen binding domains against a second target located on the carboxyl terminal side of the dimerized Fc region.

The CGRPR/PAC1 IgG-Fab consists of two antigen binding domains, one directed against the CGRP receptor and the other against the PAC1 receptor. The DNA molecules encoding CGRPR-PAC1 IgG-Fab molecules contain fragments encoding an anti-CGRP receptor (or anti-PAC1 receptor) antibody light chain, an anti-CGRP receptor (or anti-PAC1 receptor) antibody heavy chain in which the C-terminus is fused to (i) an anti-PAC1 receptor (or anti-CGRP receptor) antibody light chain or (ii) an anti-PAC1 receptor (or anti-CGRP receptor) Fd (VH-CH1), and a third polypeptide comprising the other half of the Fab fragment to complete the carboxy-terminal binding domain (e.g. (i) an anti-PAC1 receptor (or anti-CGRP receptor) Fd or (ii) an anti-PAC1 receptor (or anti-CGRP receptor) antibody light chain. The IgG-Fab bispecific molecules contain charge pair mutations introduced into CH1 and CL domains of each Fab region (Fab 1 and Fab 2 as illustrated in FIG. 3). The charge pairs are designed to allow preferential assembly of anti-CGRPR light chain/VHCH1(Fd) pair and anti-PAC1 light chain/

VHCH1 (Fd) pair. As an additional approach to promote correct pairing of the light chain/VHCH1 (Fd) pair, for a subset of the IgG-Fab molecules generated, the CL and CH1 regions in the carboxyl-terminal Fab (i.e. Fab 2) were swapped such that the polypeptide fused to the carboxyl-terminal region of the heavy chain of the second antibody comprised VL and CH1 regions from the first antibody and the second polypeptide comprised VH and CL regions from the first antibody. See molecules designated iPS:392513, iPS:392514, iPS:392475, iPS: 392519, iPS:392524, iPS: 392525, iPS:392526, and iPS: 392527 in Table 10. The DNA molecules were generated by synthesized gBlocks and cloned into the pTT5.1 vector. These expression vectors were used to transfect and express the CGRPR/PAC1 bispecific molecules in human 293 6E cells. Twenty four different IgG-Fab bispecific molecules were generated. The full sequences for each molecule are set forth in Table 10.

The IgG-Fab molecules were tested for their ability to inhibit ligand-induced activation of the human CGRP receptor and the human PAC1 receptor using in vitro cAMP assays as described in Example 3. IC50 values for each of the molecules for each target receptor are shown in Table 18 below.

TABLE 18

Inhibitory activity of bispecific IgG-Fab molecules against the human CGRP receptor and human PAC1 receptor

| Bispecific IgG-Fab Designation | Human CGRP Receptor IC50 (nM) | Human PAC1 Receptor IC50 (nM) |
| --- | --- | --- |
| iPS:392475 | 20.44 | 4.78 |
| iPS:392513 | 60.16 | 2.70 |
| iPS:392514 | 53.95 | 4.69 |
| iPS:392515 | 12.90 | 2.66 |
| iPS:392516 | 27.85 | 9.30 |
| iPS:392517 - lot #1 | 10.89 | 2.48 |
| iPS:392517 - lot #2 | 11.48 | 7.75 |
| iPS:392518 | 17.75 | 3.40 |

TABLE 18-continued

Inhibitory activity of bispecific IgG-Fab molecules against the human CGRP receptor and human PAC1 receptor

| Bispecific IgG-Fab Designation | Human CGRP Receptor IC50 (nM) | Human PAC1 Receptor IC50 (nM) |
| --- | --- | --- |
| iPS:392519 | 81.28 | 6.87 |
| iPS:392520 | 10.50 | 6.28 |
| iPS:392521 | 18.76 | 6.88 |
| iPS:392522 - lot #1 | 8.80 | 9.32 |
| iPS:392522 - lot #2 | 7.58 | 3.29 |
| iPS:392523 | 20.38 | 5.03 |
| iPS:392524 | 0.86 | 81.20 |
| iPS:392525 | 1.22 | 37.14 |
| iPS:392526 | 0.71 | 115.58 |
| iPS:392527 | 0.42 | 16.40 |
| iPS:392528 | 0.55 | >1000 |
| iPS:392529 | 0.56 | >1000 |
| iPS:392530 | 0.38 | >1000 |
| iPS:392531 | 0.42 | >1000 |
| iPS:392532 | 0.51 | 352.50 |
| iPS:392533 | 0.59 | 205.80 |
| iPS:392534 | 0.37 | 349.20 |
| iPS:392535 | 0.41 | 365.03 |

All but four of the bispecific IgG-Fab molecules tested exhibited inhibitory activity against both receptors.

All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the following claims.

SEQUENCE LISTING (646 sequences)

SEQ ID NO: 1 - protein, 11 aa, Artificial Sequence
  source: /note="Description of Artificial Sequence: Synthetic peptide"
RASQSISRYLN

SEQ ID NO: 2 - protein, 11 aa, Artificial Sequence
  source: /note="Description of Artificial Sequence: Synthetic peptide"
RASQSIGRSLH

SEQ ID NO: 3 - protein, 11 aa, Artificial Sequence
  source: /note="Description of Artificial Sequence: Synthetic peptide"
RASQSVGRSLH

SEQ ID NO: 4 - protein, 17 aa, Artificial Sequence
  source: /note="Description of Artificial Sequence: Synthetic peptide"
KSSQSVLYSSNNKNFLT

SEQ ID NO: 5 - protein, 11 aa, Artificial Sequence
  source: /note="Description of Artificial Sequence: Synthetic peptide"
RASQSIGSSLH

SEQ ID NO: 6 - protein, 12 aa, Artificial Sequence
  source: /note="Description of Artificial Sequence: Synthetic peptide"
RASQSVSSSYLA

SEQ ID NO: 7 - protein, 16 aa, Artificial Sequence
  source: /note="Description of Artificial Sequence: Synthetic peptide"
RSSQSLLHSNGYNYLD

SEQ ID NO: 8 - protein, 12 aa, Artificial Sequence
  source: /note="Description of Artificial Sequence: Synthetic peptide"
RASQTVSRSYLA

SEQ ID NO: 9 - protein, 17 aa, Artificial Sequence
  source: /note="Description of Artificial Sequence: Synthetic peptide"
KSSQNVLYSSNNKNFLT

SEQ ID NO: 10 - protein, 17 aa, Artificial Sequence
  source: /note="Description of Artificial Sequence: Synthetic peptide"
KSSQSVLYRSNNNNFLA

SEQ ID NO: 11 - protein, 17 aa, Artificial Sequence
  source: /note="Description of Artificial Sequence: Synthetic peptide"
KSSQSVLYSSNNKHYLA

SEQ ID NO: 12 - protein, 17 aa, Artificial Sequence
  source: /note="Description of Artificial Sequence: Synthetic peptide"
KSSQSVLYSSNNRNFLS

SEQ ID NO: 13 - protein, 17 aa, Artificial Sequence
  source: /note="Description of Artificial Sequence: Synthetic peptide"
KSSQSVLYSSNNKNYLA

SEQ ID NO: 14 - protein, 7 aa, Artificial Sequence
  source: /note="Description of Artificial Sequence: Synthetic peptide"
AASSLQS

SEQ ID NO: 15 - protein, 7 aa, Artificial Sequence
  source: /note="Description of Artificial Sequence: Synthetic peptide"
YASQSLS

SEQ ID NO: 16 - protein, 7 aa, Artificial Sequence
  source: /note="Description of Artificial Sequence: Synthetic peptide"
RASTRES

SEQ ID NO: 17 - protein, 7 aa, Artificial Sequence
  source: /note="Description of Artificial Sequence: Synthetic peptide"
GASSRAT

SEQ ID NO: 18 - protein, 7 aa, Artificial Sequence
  source: /note="Description of Artificial Sequence: Synthetic peptide"
LGSNRAS

SEQ ID NO: 19 - protein, 7 aa, Artificial Sequence
  source: /note="Description of Artificial Sequence: Synthetic peptide"
WASTRES

SEQ ID NO: 20 - protein, 9 aa, Artificial Sequence
  source: /note="Description of Artificial Sequence: Synthetic peptide"
QQSYSPPFT

SEQ ID NO: 21 - protein, 9 aa, Artificial Sequence
  source: /note="Description of Artificial Sequence: Synthetic peptide"
HQSSRLPFT

SEQ ID NO: 22 - protein, 9 aa, Artificial Sequence
  source: /note="Description of Artificial Sequence: Synthetic peptide"
QQYYSAPFT

SEQ ID NO: 23 - protein, 8 aa, Artificial Sequence
  source: /note="Description of Artificial Sequence: Synthetic peptide"
QRYGSSRT

SEQ ID NO: 24 - protein, 9 aa, Artificial Sequence
  source: /note="Description of Artificial Sequence: Synthetic peptide"
MQTLQTPFT

SEQ ID NO: 25 - protein, 9 aa, Artificial Sequence
  source: /note="Description of Artificial Sequence: Synthetic peptide"
QQFGSSPWT

SEQ ID NO: 26 - protein, 9 aa, Artificial Sequence
  source: /note="Description of Artificial Sequence: Synthetic peptide"
QQYYISPLT

SEQ ID NO: 27 - protein, 9 aa, Artificial Sequence
  source: /note="Description of Artificial Sequence: Synthetic peptide"
QQYYSSPFT

SEQ ID NO: 28 - protein, 108 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGPGTKVDIKR

SEQ ID NO: 29 - protein, 108 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGEGTKVDIKR

SEQ ID NO: 30 - protein, 108 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGQGTKVDIKR

SEQ ID NO: 31 - protein, 108 aa, Artificial Sequence
  source: /note="Description of Artificial Sequence: Synthetic polypeptide"
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKR

SEQ ID NO: 32 - protein, 108 aa, Artificial Sequence
  source: /note="Description of Artificial Sequence: Synthetic polypeptide"
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGEGTKVDIKR

SEQ ID NO: 33 - protein, 108 aa, Artificial Sequence [sequence omitted]

SEQ ID NO: 34 - protein, 108 aa, Artificial Sequence
  source: /note="Description of Artificial Sequence: Synthetic polypeptide"
EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGEGTKVDIKR

SEQ ID NO: 35 - protein, 114 aa, Artificial Sequence
  source: /note="Description of Artificial Sequence: Synthetic polypeptide"
DIVMTQSPDSLAVSLGERATIHCKSSQSVLYSSNNKNFLTWYQQKPGQPPKLLIYRASTRESGVPDRFSGSGSGTDFTLTISSLQAEDVAVYFCQQYYSAPFTFGPGTRVDIKR

SEQ ID NO: 36 - protein, 114 aa, Artificial Sequence
  source: /note="Description of Artificial Sequence: Synthetic polypeptide"
DIVMTQSPDSLAVSLGERATIHCKSSQSVLYSSNNKNFLTWYQQKPGQPPKLLIYRASTRESGVPDRFSGSGSGTDFTLTISSLQAEDVAVYFCQQYYSAPFTFGEGTRVDIKR

SEQ ID NO: 37 - protein, 114 aa, Artificial Sequence
  source: /note="Description of Artificial Sequence: Synthetic polypeptide"
DIVMTQSPDSLAVSLGERATINCKSSQSVLYSSNNKNFLTWYQQKPGQPPKLLIYRASTRESGVPDRFSGSGSGTDFTLTISSLQAEDVAVYFCQQYYSAPFTFGPGTRVDIKR

SEQ ID NO: 38 - protein, 114 aa, Artificial Sequence
  source: /note="Description of Artificial Sequence: Synthetic polypeptide"
DIVMTQSPDSLAVSLGERATINCKSSQSVLYSSNNKNFLTWYQQKPGQPPKLLIYRASTRESGVPDRFSGSGSGTDFTLTISSLQAEDVAVYFCQQYYSAPFTFGEGTRVDIKR

SEQ ID NO: 39 - protein, 108 aa, Artificial Sequence
  source: /note="Description of Artificial Sequence: Synthetic polypeptide"
EIVLTQSPDFQSVTPKEKVTITCRASQSIGSSLHWYQQKPDQSPKLLIKYASQSLSGIPSRFSGSGSGTHFTLTINSLEAEDAATYYCHQSSRLPFTFGPGTKVDIKR

SEQ ID NO: 40 - protein, 108 aa, Artificial Sequence
  source: /note="Description of Artificial Sequence: Synthetic polypeptide"
EIVLTQSPDFQSVTPKEKVTITCRASQSVGRSLHWYHQKPDQSPKLLIKYASQSLSGVPSRFSGSGSGTDFTLIINSLEAEDAATYYCHQSSRLPFTFGPGTKVDIKR

SEQ ID NO: 41 - protein, 108 aa, Artificial Sequence
  source: /note="Description of Artificial Sequence: Synthetic polypeptide"
DIQLTQSPSFLSASVGDRVTITCRASQSIGRSLHWYHQKPGKAPKLLIKYASQSLSGVPSRFSGSGSGTEFTLIISSLQPEDFATYYCHQSSRLPFTFGPGTKVDIKR

SEQ ID NO: 42 - protein, 108 aa, Artificial Sequence
  source: /note="Description of Artificial Sequence: Synthetic polypeptide"
EIVLTQSPDFQSVTPKEKVTITCRASQSVGRSLHWYQQKPDQSPKLLIKYASQSLSGVPSRFSGSGSGTDFTLTINSLEAEDAATYYCHQSSRLPFTFGPGTKVDIKR

SEQ ID NO: 43 - protein, 108 aa, Artificial Sequence
  source: /note="Description of Artificial Sequence: Synthetic polypeptide"
EIVLTQSPGTLSLSPGERATLSCRASQSVGRSLHWYQQKPGQAPRLLIKYASQSLSGIPDRFSGSGSGTDFTLTISRLEPEDFATYYCHQSSRLPFTFGQGTKVEIKR

SEQ ID NO: 44 - protein, 108 aa, Artificial Sequence
  source: /note="Description of Artificial Sequence: Synthetic polypeptide"
EIVLTQSPDFQSVTPKEKVTITCRASQSIGRSLHWYQQKPDQSPKLLFKYASQSLSGVPSRFSGSGSGTDFTLTINSLEAEDAATYYCHQSSRLPFTFGPGTKVDIKR

SEQ ID NO: 45 - protein, 108 aa, Artificial Sequence
  source: /note="Description of Artificial Sequence: Synthetic polypeptide"
DIQLTQSPSFLSASVGDRVTITCRASQSIGRSLHWYQQKPGKAPKLLFKYASQSLSGVPSRFSGSGSGTEFTLTISSLQPEDFATYYCHQSSRLPFTFGPGTKVDIKR

SEQ ID NO: 46 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSNSGSGTDFTLTISRLEPEDFAVYYCQRYGSSRTFGQGTKVEIKR

SEQ ID NO: 47 - protein, 113 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLLYLGSNRASGVPDRFSGSGSGTDFTLQISRVEAEDVGVYYCMQTLQTPFTFGPGTKVDIKR

SEQ ID NO: 48 - protein, 113 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLLYLGSNRASGVPDRFSGSGSGTDFTLKISRVEAEDVGVYYCMQTLQTPFTFGPGTKVDIKR

SEQ ID NO: 49 - protein, 109 aa, Artificial Sequence
  source: /note="Description of Artificial Sequence: Synthetic polypeptide"
EIVLTQSPGTLSLSPGERATLSCRASQTVSRSYLAWYQQKPGQAPRLLIYGASSRATGIPDRFSGSGSGTDFTLTISRLEPEDFAVFYCQQFGSSPWTFGQGTKVEIKR

SEQ ID NO: 50 - protein, 114 aa, Artificial Sequence
  source: /note="Description of Artificial Sequence: Synthetic polypeptide"
DIVMTQSPDSLAVSLGERATIHCKSSQNVLYSSNNKNFLTWYQQKPGQPPKLLIYRASTRESGVPDRFSGSGSGTDFTLTISSLQAEDVAVYFCQQYYSAPFTFGPGTKVDIKR

SEQ ID NO: 51 - protein, 114 aa, Artificial Sequence
  source: /note="Description of Artificial Sequence: Synthetic polypeptide"
DIVMTQSPDSLAVSLGERTTIKCKSSQSVLYRSNNNNFLAWYQQKPGQPPKLLIYWASTRESGVPDRFSGSGSGTDFTLTISSLQAEDVAVYFCQQYYISPLTFGGGTKVEIKR

SEQ ID NO: 52 - protein, 114 aa, Artificial Sequence
  source: /note="Description of Artificial Sequence: Synthetic polypeptide"
DIVMTQSPDSLAVSLGERATINCKSSQSVLYSSNNKHYLAWYRQKPGQPPKLLIYRASTRESGVPDRFSGSGSGTDFTLTISSLQPEDVAVYYCQQYYSSPFTFGPGTKVDIKR

SEQ ID NO: 53 - protein, 114 aa, Artificial Sequence
  source: /note="Description of Artificial Sequence: Synthetic polypeptide"
DIVMTQSPDSLAVSLGERATIHCKSSQSVLYSSNNRNFLSWYQQKPGQPPKLLIYRASTRESGVPDRFSGSGSGTDFTLTISSLQAEDVAVYFCQQYYSAPFTFGPGTTVDIKR

SEQ ID NO: 54 - protein, 114 aa, Artificial Sequence
  source: /note="Description of Artificial Sequence: Synthetic polypeptide"
DIVMTQSPDSLAVSLGERATINCKSSQSVLYSSNNKNYLAWYRQKPGQPPKLLIYRASTRESGVPDRFSGSGSGTDFTLTISSLQAEDVAVYHCQQYYSSPFTFGPGTKVDIKR

SEQ ID NO: 55 - protein, 7 aa, Artificial Sequence
  source: /note="Description of Artificial Sequence: Synthetic peptide"
SNSATWN

SEQ ID NO: 56 - protein, 5 aa, Artificial Sequence
  source: /note="Description of Artificial Sequence: Synthetic peptide"
RFAMH

SEQ ID NO: 57 - protein, 7 aa, Artificial Sequence
  source: /note="Description of Artificial Sequence: Synthetic peptide"
SGGYYWS

SEQ ID NO: 58 - protein, 5 aa, Artificial Sequence
  source: /note="Description of Artificial Sequence: Synthetic peptide"
YYAIH

SEQ ID NO: 59 - protein, 5 aa, Artificial Sequence
  source: /note="Description of Artificial Sequence: Synthetic peptide"
RYAMH

SEQ ID NO: 60 - protein, 5 aa, Artificial Sequence
  source: /note="Description of Artificial Sequence: Synthetic peptide"
SYGIS

SEQ ID NO: 61 - protein, 5 aa, Artificial Sequence
  source: /note="Description of Artificial Sequence: Synthetic peptide"
RYGVS

SEQ ID NO: 62 - protein, 5 aa, Artificial Sequence
  source: /note="Description of Artificial Sequence: Synthetic peptide"
SYYWS

SEQ ID NO: 63 - protein, 7 aa, Artificial Sequence
  source: /note="Description of Artificial Sequence: Synthetic peptide"
SNSAAWN

SEQ ID NO: 64 - protein, 7 aa, Artificial Sequence
  source: /note="Description of Artificial Sequence: Synthetic peptide"
RGGYYWS

SEQ ID NO: 65 - protein, 7 aa, Artificial Sequence
  source: /note="Description of Artificial Sequence: Synthetic peptide"
SGGFYWS

SEQ ID NO: 66 - protein, 18 aa, Artificial Sequence
  source: /note="Description of Artificial Sequence: Synthetic peptide"
RTYYRSKWSNHYAVSVKS

SEQ ID NO: 67 - protein, 17 aa, Artificial Sequence
  source: /note="Description of Artificial Sequence: Synthetic peptide"
VISYDGGNKYYAESVKG

SEQ ID NO: 68 - protein, 16 aa, Artificial Sequence
  source: /note="Description of Artificial Sequence: Synthetic peptide"
YIYYSGNTYYNPSLKS

SEQ ID NO: 69 - protein, 17 aa, Artificial Sequence
  source: /note="Description of Artificial Sequence: Synthetic peptide"
VISYDGSNKYYADSVKG

SEQ ID NO: 70 - protein, 17 aa, Artificial Sequence
  source: /note="Description of Artificial Sequence: Synthetic peptide"
WINAYNGHTNYAQTFQG

SEQ ID NO: 71 - protein, 17 aa, Artificial Sequence
  source: /note="Description of Artificial Sequence: Synthetic peptide"
WITTYNGNTNYAQKLQG

SEQ ID NO: 72 - protein, 16 aa, Artificial Sequence
  source: /note="Description of Artificial Sequence: Synthetic peptide"
RIYTSGSTNYNPSLKS

SEQ ID NO: 73 - protein, 18 aa, Artificial Sequence
  source: /note="Description of Artificial Sequence: Synthetic peptide"
RTYYRSRWYNDYAVSVKS

SEQ ID NO: 74 - protein, 11 aa, Artificial Sequence
  source: /note="Description of Artificial Sequence: Synthetic peptide"
GTWKQLWFLDH

SEQ ID NO: 75 - protein, 11 aa, Artificial Sequence
  source: /note="Description of Artificial Sequence: Synthetic peptide"
GYDVLTGYPDY

SEQ ID NO: 76 - protein, 9 aa, Artificial Sequence
  source: /note="Description of Artificial Sequence: Synthetic peptide"
GGAARGMDV

SEQ ID NO: 77 - protein, 11 aa, Artificial Sequence
  source: /note="Description of Artificial Sequence: Synthetic peptide"
GYDLLTGYPDY

SEQ ID NO: 78 - protein, 11 aa, Artificial Sequence
  source: /note="Description of Artificial Sequence: Synthetic peptide"
GYDILTGYPDY

SEQ ID NO: 79 - protein, 14 aa, Artificial Sequence
  source: /note="Description of Artificial Sequence: Synthetic peptide"
ELELRSFYYFGMDV

SEQ ID NO: 80 - protein, 12 aa, Artificial Sequence
  source: /note="Description of Artificial Sequence: Synthetic peptide"
RVRYSGGYSFDN

SEQ ID NO: 81 - protein, 10 aa, Artificial Sequence
  source: /note="Description of Artificial Sequence: Synthetic peptide"
IASRGWYFDL

SEQ ID NO: 82 - protein, 11 aa, Artificial Sequence
  source: /note="Description of Artificial Sequence: Synthetic peptide"
GVFYSKGAFDI

SEQ ID NO: 83 - protein, 123 aa, Artificial Sequence
  source: /note="Description of Artificial Sequence: Synthetic polypeptide"
QVQLQQSGPGLVKPSQTLSLTCAISGDSVSSNSATWNWIRQSPSRGLEWLGRTYYRSKWSNHYAVSVKSRITINPDTSKSQFSLQLNSVTPEDTAVYYCARGTWKQLWFLDHWGQGTLVTVSS

SEQ ID NO: 84 - protein, 123 aa, Artificial Sequence
  source: /note="Description of Artificial Sequence: Synthetic polypeptide"
QVQLQQSGPGLVKPSQTLSLTCAISGDSVSSNSATWNWIRQSPSRKLEWLGRTYYRSKWSNHYAVSVKSRITINPDTSKSQFSLQLNSVTPEDTAVYYCARGTWKQLWFLDHWGQGTLVTVSS

SEQ ID NO: 85 - protein, 120 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSS

SEQ ID NO: 86 - protein, 120 aa, Artificial Sequence
  source: /note="Description of Artificial Sequence: Synthetic polypeptide"
QVQLVESGAEVVKPGASVKVSCKASGFTFSRFAMHWVRQAPGQKLEWMGVISYDGGNKYYAESVKGRVTMTRDTSTSTLYMELSSLRSEDTAVYYCARGYDVLTGYPDYWGQGTLVTVSS

SEQ ID NO: 87 - protein, 120 aa, Artificial Sequence [sequence omitted]

SEQ ID NO: 88 - protein, 120 aa, Artificial Sequence
  source: /note="Description of Artificial Sequence: Synthetic polypeptide"
QVQLVESGGGVVQPGRSLRLSCAASGFTFSRFAMHWVRQAPGKKLEWVAVISYDGGNKYYAESVKGRFTISRDNSKNTLYLQMNSLRAEDTALFYCARGYDVLTGYPDYWGQGTLVTVSS

SEQ ID NO: 89 - protein, 119 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGNTYYNPSLKSRVTISGDTSKNQFSLKLRSVTAADTAVYYCTRGGAARGMDVWGQGTTVTVSS

SEQ ID NO: 90 - protein, 119 aa, Artificial Sequence
  source: /note="Description of Artificial Sequence: Synthetic polypeptide"
QVQLQESGPGLVKPSQTLSLTCTVSGGSISSGGYYWSWIRQHPGKKLEWIGYIYYSGNTYYNPSLKSRVTISGDTSKNQFSLKLRSVTAADTAVYYCTRGGAARGMDVWGQGTTVTVSS

SEQ ID NO: 91 - protein, 119 aa, Artificial Sequence
  source: /note="Description of Artificial Sequence: Synthetic polypeptide"
QVQLQESGPGLVKPSETLSLTCTVSGGSISSGGYYWSWIRQPPGKGLEWIGYIYYSGNTYYNPSLKSRVTISVDTSKNQFSLKLRSVTAADTAVYYCTRGGAARGMDVWGQGTTVTVSS

SEQ ID NO: 92 - protein, 119 aa, Artificial Sequence
  source: /note="Description of Artificial Sequence: Synthetic polypeptide"
QVQLQESGPGLVKPSETLSLTCTVSGGSISSGGYYWSWIRQPPGKKLEWIGYIYYSGNTYYNPSLKSRVTISVDTSKNQFSLKLRSVTAADTAVYYCTRGGAARGMDVWGQGTTVTVSS

SEQ ID NO: 93 - protein, 120 aa, Artificial Sequence
  source: /note="Description of Artificial Sequence: Synthetic polypeptide"
QVQLVESGGGVVQPGRSLRLSCAASGFTFSYYAIHWVRQAPGKGLEWVAVISYDGSNKYYADSVKGRFTISRDNSKNTLYLQMNSLRAEDTAVYYCARGYDLLTGYPDYWGQGTLVTVSS

SEQ ID NO: 94 - protein, 120 aa, Artificial Sequence
  source: /note="Description of Artificial Sequence: Synthetic polypeptide"
QVQLVESGGGVVQPGRSLRLSCAASGFTFSRFAMHWVRRAPGKGLEWVAVISYDGGNKYYAESVKGRFTISRDNSKNTLNLLMNSLRAEDTALFYCARGYDVLTGYPDYWGQGTLVTVSS

SEQ ID NO: 95 - protein, 120 aa, Artificial Sequence
  source: /note="Description of Artificial Sequence: Synthetic polypeptide"
QVQLVESGGGVVQPGRSLRLSCAASGFTFSRFAMHWVRQAPGKGLEWVAVISYDGGNKYYAESVKGRFTISRDNSKNTLNLLMNSLRAEDTALFYCARGYDVLTGYPDYWGQGTLVTVSS

SEQ ID NO: 96 - protein, 120 aa, Artificial Sequence
  source: /note="Description of Artificial Sequence: Synthetic polypeptide"
QVQLVESGGGVVQPGRSLRLSCAASGFTFSRFAMHWVRRAPGKGLEWVAVISYDGGNKYYAESVKGRFTISRDNSKNTLNLLMDSLRAEDTALFYCARGYDVLTGYPDYWGQGTLVTVSS

SEQ ID NO: 97 - protein, 120 aa, Artificial Sequence
  source: /note="Description of Artificial Sequence: Synthetic polypeptide"
QVQLVQSGAEVKKPGASVKVSCKASGFTFSRFAMHWVRQAPGQGLEWMGVISYDGGNKYYAESVKGRVTMTRDTSTSTAYMELSSLRSEDTAVYYCARGYDVLTGYPDYWGQGTLVTVSS

SEQ ID NO: 98 - protein, 120 aa, Artificial Sequence
  source: /note="Description of Artificial Sequence: Synthetic polypeptide"
QVQLVQSGAEVKKPGASVKVSCAASGFTFSRFAMHWVRQAPGQGLEWMGVISYDGGNKYYAESVKGRVTMTRDNSKNTAYMELSSLRSEDTAVYYCARGYDVLTGYPDYWGQGTLVTVSS

SEQ ID NO: 99 - protein, 120 aa, Artificial Sequence
  source: /note="Description of Artificial Sequence: Synthetic polypeptide"
EVQLLESGGGLVQPGGSLRLSCAASGFTFSRFAMHWVRQAPGKGLEWVAVISYDGGNKYYAESVKGRFTISRDNSKNTLYLQMNSLRAEDTAVYYCARGYDVLTGYPDYWGQGTLVTVSS

SEQ ID NO: 100 - protein, 120 aa, Artificial Sequence
  source: /note="Description of Artificial Sequence: Synthetic polypeptide"
QVQLVESGGGVVQPGRSLRLSCAASGFTFSRYAMHWVRQASGKGLEWVAVISYDGSNKYYADSVKGRFTISRDNSKNTLYLLMSSLRAEDTAVFYCARGYDILTGYPDYWGQGTLVTVSS

SEQ ID NO: 101 - protein, 123 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWINAYNGHTNYAQTFQGRVTMTTDTSTSTAYMELRSLRSDDTAVYYCARELELRSFYYFGMDVWGQGTTVPVSS

SEQ ID NO: 102 - protein, 121 aa, Artificial Sequence
  source: /note="Description of Artificial Sequence: Synthetic polypeptide"
QVQLVQSGAEVKKSGASLKVSCKASGYIFTRYGVSWVRQAPGQGLEWMGWITTYNGNTNYAQKLQGRVTMTIDTSTSTAYMELRSLRSDDTAVYYCARRVRYSGGYSFDNWGQGTLVTVSS

SEQ ID NO: 103 - protein, 121 aa, Artificial Sequence
  source: /note="Description of Artificial Sequence: Synthetic polypeptide"
QVQLVQSGAEVKKSGASLKVSCKASGYIFTRYGVSWVRQAPGQGLEWMGWITTYNGNTNYAQKLQGRVTMTTDTSTSTAYMELRSLRSDDTAVYYCARRVRYSGGYSFDNWGQGTLVTVSS

SEQ ID NO: 104 - protein, 118 aa, Artificial Sequence
  source: /note="Description of Artificial Sequence: Synthetic polypeptide"
QVQLQESGPGLVKPSETLSLTCTVSGGSISSYYWSWIRQPAGKGLEWIGRIYTSGSTNYNPSLKSRVTMSIGTSKNQFSLKLSSVTAADTAVYYCAIIASRGWYFDLWGRGTLVTVSS

SEQ ID NO: 105 - protein, 119 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGNTYYNPSLKSRVTISGDTSKNQFSLKLRSVTAADTAVYYCARGGAARGMDVWGQGTTVTVSS

SEQ ID NO: 106 - protein, 123 aa, Artificial Sequence
  source: /note="Description of Artificial Sequence: Synthetic polypeptide"
QVQLQQSGPGLVKPSQTLSLTCAISGDSVSSNSAAWNWIRQSPSRGLEWLGRTYYRSRWYNDYAVSVKSRITINPDTSKNQFSLQLNSVTPEDTAVYYCARGVFYSKGAFDIWGQGTMVTVSS

SEQ ID NO: 107 - protein, 119 aa, Artificial Sequence
  source: /note="Description of Artificial Sequence: Synthetic polypeptide"
QVQLQESGPGLVKPSQTLSLTCTVSGGSISRGGYYWSWIRQHPGKGLEWIGYIYYSGNTYYNPSLKSRVIISGDTSKNQLSLKLRSVTAADTAVYYCARGGAARGMDVWGQGTTVTVSS

SEQ ID NO: 108 - protein, 119 aa, Artificial Sequence
  source: /note="Description of Artificial Sequence: Synthetic polypeptide"
QVQLQESGPGLVKPSQTLSLTCTVSGGSISSGGFYWSWIRQHPGKGLEWIGYIYYSGNTYYNPSLKSRVIISGDTSKNQFSLKLSSVTAADTAVYYCARGGAARGMDVWGQGTTVTVSS

SEQ ID NO: 109 - protein, 13 aa, Artificial Sequence
  source: /note="Description of Artificial Sequence: Synthetic peptide"
SGSSSNIGSNYVY

SEQ ID NO: 110 - protein, 13 aa, Artificial Sequence
  source: /note="Description of Artificial Sequence: Synthetic peptide"
SGSSSNIGNNYVS

SEQ ID NO: 111 - protein, 12 aa, Artificial Sequence
  source: /note="Description of Artificial Sequence: Synthetic peptide"
RASQSVSSGYLT

SEQ ID NO: 112 - protein, 11 aa, Artificial Sequence
  source: /note="Description of Artificial Sequence: Synthetic peptide"
RASQGIRNDLG

SEQ ID NO: 113 - protein, 11 aa, Artificial Sequence
  source: /note="Description of Artificial Sequence: Synthetic peptide"
QGDSLRSFYAS

SEQ ID NO: 114 - protein, 16 aa, Artificial Sequence
  source: /note="Description of Artificial Sequence: Synthetic peptide"
KSSQSLLHSAGKTYLY

SEQ ID NO: 115 - protein, 16 aa, Artificial Sequence
  source: /note="Description of Artificial Sequence: Synthetic peptide"
RSSQSLLHSFGYNYLD

SEQ ID NO: 116 - protein, 16 aa, Artificial Sequence
  source: /note="Description of Artificial Sequence: Synthetic peptide"
KSSQSLLHSDGKTYLY

SEQ ID NO: 117 - protein, 13 aa, Artificial Sequence
  source: /note="Description of Artificial Sequence: Synthetic peptide"
SGSSSNIGSNTVN

SEQ ID NO: 118 - protein, 16 aa, Artificial Sequence
  source: /note="Description of Artificial Sequence: Synthetic peptide"
KSSQSLLHSDGRNYLY

SEQ ID NO: 119 - protein, 11 aa, Artificial Sequence
  source: /note="Description of Artificial Sequence: Synthetic peptide"
RASQGIRKDLG

SEQ ID NO: 120 - protein, 7 aa, Artificial Sequence
  source: /note="Description of Artificial Sequence: Synthetic peptide"
RNNQRPS

SEQ ID NO: 121 - protein, 7 aa, Artificial Sequence
  source: /note="Description of Artificial Sequence: Synthetic peptide"
DNNKRPS

SEQ ID NO: 122 - protein, 7 aa, Artificial Sequence
  source: /note="Description of Artificial Sequence: Synthetic peptide"
RSNQRPS

SEQ ID NO: 123 - protein, 7 aa, Artificial Sequence
  source: /note="Description of Artificial Sequence: Synthetic peptide"
GKNNRPS

SEQ ID NO: 124 - protein, 7 aa, Artificial Sequence
  source: /note="Description of Artificial Sequence: Synthetic peptide"
EVSNRFS

SEQ ID NO: 125 - protein, 7 aa, Artificial Sequence
  source: /note="Description of Artificial Sequence: Synthetic peptide"
TNNQRPS

SEQ ID NO: 126 - protein, 7 aa, Artificial Sequence
  source: /note="Description of Artificial Sequence: Synthetic peptide"
GASSLQS

SEQ ID NO: 127 - protein, 11 aa, Artificial Sequence
  source: /note="Description of Artificial Sequence: Synthetic peptide"
AAWDDSLSGWV

SEQ ID NO: 128 - protein, 11 aa, Artificial Sequence
  source: /note="Description of Artificial Sequence: Synthetic peptide"
GTWDSRLSAVV

SEQ ID NO: 129 - protein, 9 aa, Artificial Sequence
  source: /note="Description of Artificial Sequence: Synthetic peptide"
QQYGNSLSR

SEQ ID NO: 130 - protein, 9 aa, Artificial Sequence
  source: /note="Description of Artificial Sequence: Synthetic peptide"
LQYNIYPWT

SEQ ID NO: 131 - protein, 11 aa, Artificial Sequence
  source: /note="Description of Artificial Sequence: Synthetic peptide"
NSRDSSVYHLV

SEQ ID NO: 132 - protein, 9 aa, Artificial Sequence
  source: /note="Description of Artificial Sequence: Synthetic peptide"
MQSFPLPLT

SEQ ID NO: 133 - protein, 9 aa, Artificial Sequence
  source: /note="Description of Artificial Sequence: Synthetic peptide"
MQALQTPFT

SEQ ID NO: 134 - protein, 11 aa, Artificial Sequence
  source: /note="Description of Artificial Sequence: Synthetic peptide"
AARDESLNGVV

SEQ ID NO: 135 - protein, 9 aa, Artificial Sequence
  source: /note="Description of Artificial Sequence: Synthetic peptide"
LQYNSFPWT

SEQ ID NO: 136 - protein, 111 aa, Artificial Sequence
  source: /note="Description of Artificial Sequence: Synthetic polypeptide"
QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGGGTKLTVLG

SEQ ID NO: 137 - protein, 111 aa, Artificial Sequence
  source: /note="Description of Artificial Sequence: Synthetic polypeptide"
QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGKGTKLTVLG

SEQ ID NO: 138 - protein, 111 aa, Artificial Sequence
  source: /note="Description of Artificial Sequence: Synthetic polypeptide"
QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGGGTKLTVLG

SEQ ID NO: 139 - protein, 111 aa, Artificial Sequence
  source: /note="Description of Artificial Sequence: Synthetic polypeptide"
QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGKGTKLTVLG

SEQ ID NO: 140 - protein, 111 aa, Artificial Sequence [sequence omitted]

SEQ ID NO: 141 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGKGTKLTVLG

SEQ ID NO: 142 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLG

SEQ ID NO: 143 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGKGTKLTVLG

SEQ ID NO: 144 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVLG

SEQ ID NO: 145 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGKGTKLTVLG

SEQ ID NO: 146 - protein, 109 aa, Artificial Sequence
  source: /note="Description of Artificial Sequence: Synthetic polypeptide"
EIVLTQSPGTLSLSPGERATLSCRASQSVSSGYLTWYQQKPGQAPRLLIYGASSRATGIPDRFSGSGSGTDFTLTISRLEPEDFAVYYCQQYGNSLSRFGQGTKLEIKR

SEQ ID NO: 147 - protein, 109 aa, Artificial Sequence
  source: /note="Description of Artificial Sequence: Synthetic polypeptide"
EIVLTQSPGTLSLSPGERATLSCRASQSVSSGYLTWYQQKPGQAPRLLIYGASSRATGIPDRFSGSGSGTDFTLTISRLEPEDFAVYYCQQYGNSLSRFGKGTKLEIKR

SEQ ID NO: 148 - protein, 110 aa, Artificial Sequence
  source: /note="Description of Artificial Sequence: Synthetic polypeptide"
QSVLTQPPSVSEAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVL

SEQ ID NO: 149 - protein, 110 aa, Artificial Sequence
  source: /note="Description of Artificial Sequence: Synthetic polypeptide"
QSVLTQPPSASGTPGQRVTISCSGSSSNIGSNYVYWYQQLPGAAPKLLIFRSNQRPSGVPDRFSGSKSGTSASLAISGLRSEDEADYYCAAWDDSLSGWVFGGGTKLTVL

SEQ ID NO: 150 - protein, 107 aa, Artificial Sequence
  source: /note="Description of Artificial Sequence: Synthetic polypeptide"
DIQMTQSPSSLSASVGDRVTITCRASQGIRNDLGWFQQKPGKAPKRLIYAASSLQSGVPSRFSGSGSGTEFTLTISSLQPEDLATYYCLQYNIYPWTFGQGTKVEIK

SEQ ID NO: 151 - protein, 108 aa, Artificial Sequence
  source: /note="Description of Artificial Sequence: Synthetic polypeptide"
SSELTQDPTVSVALGQTVKITCQGDSLRSFYASWYQQKPGQAPVLVFYGKNNRPSGIPDRFSGSSSGNTASLTITGAQAEDEADYYCNSRDSSVYHLVLGGGTKLTVL

SEQ ID NO: 152 - protein, 112 aa, Artificial Sequence
  source: /note="Description of Artificial Sequence: Synthetic polypeptide"
DIILAQTPLSLSVTPGQPASISCKSSQSLLHSAGKTYLYWYLQKPGQPPQLLIYEVSNRFSGVPDRFSGSGSGTDFTLKISRVEAEDVGIYYCMQSFPLPLTFGGGTKVEIK

SEQ ID NO: 153 - protein, 112 aa, Artificial Sequence
  source: /note="Description of Artificial Sequence: Synthetic polypeptide"
DIVMTQSPLSLPVTPGEPASISCRSSQSLLHSFGYNYLDWYLQKPGQSPQLLIYLGSNRASGVPDRFSGSGSGTDFTLKISRVEAEDVGVYYCMQALQTPFTFGPGTKVDIK

SEQ ID NO: 154 - protein, 112 aa, Artificial Sequence
  source: /note="Description of Artificial Sequence: Synthetic polypeptide"
DIILTQTPLSLSVTPGQPASISCKSSQSLLHSDGKTYLYWYLQKPGQPPQLLIYEVSNRFSGEPDRFSGSGSGTDFTLKISRVEAEDVGTYYCMQSFPLPLTFGGGTKVEIK

SEQ ID NO: 155 - protein, 110 aa, Artificial Sequence
  source: /note="Description of Artificial Sequence: Synthetic polypeptide"
QSVLTQPPSVSAAPGQKVTISCSGSSSNIGNNYVSWYQQFPGTAPKLLIYDNNKRPSGIPDRFSGSKSGTSATLGITGLQTGDEADYYCGTWDSRLSAVVFGGGTKLTVL

SEQ ID NO: 156 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYTNNQRPSGVPDRFSGSKSGTSASLAISGLQSEDEADFYCAARDESLNGVVFGGGTKLTVL

SEQ ID NO: 157 - protein, 112 aa, Artificial Sequence
  source: /note="Description of Artificial Sequence: Synthetic polypeptide"
DITLTQTPLSLSVSPGQPASISCKSSQSLLHSDGRNYLYWYLQKPGQPPQLLIYEVSNRFSGLPDRFSGSGSGTDFTLKISRVEAEDVGIYYCMQSFPLPLTFGGGTKVEIK

SEQ ID NO: 158 - protein, 107 aa, Artificial Sequence
  source: /note="Description of Artificial Sequence: Synthetic polypeptide"
DIQMTQSPSSLSASVGDRVTITCRASQGIRKDLGWYQQKPGKAPKRLIYGASSLQSGVPSRFSGSGSGTEFTLTISSLQPEDFATYYCLQYNSFPWTFGQGTKVEIK

SEQ ID NO: 159 - protein, 5 aa, Artificial Sequence
  source: /note="Description of Artificial Sequence: Synthetic peptide"
NAWMS

SEQ ID NO: 160 - protein, 5 aa, Artificial Sequence
  source: /note="Description of Artificial Sequence: Synthetic peptide"
SFGMH

SEQ ID NO: 161 - protein, 5 aa, Artificial Sequence
  source: /note="Description of Artificial Sequence: Synthetic peptide"
SYGMH

SEQ ID NO: 162 - protein, 5 aa, Artificial Sequence
  source: /note="Description of Artificial Sequence: Synthetic peptide"
SYAMS

SEQ ID NO: 163 - protein, 5 aa, Artificial Sequence
  source: /note="Description of Artificial Sequence: Synthetic peptide"
GYYMH

SEQ ID NO: 164 - protein, 5 aa, Artificial Sequence
  source: /note="Description of Artificial Sequence: Synthetic peptide"
DYAMS

SEQ ID NO: 165 - protein, 5 aa, Artificial Sequence
  source: /note="Description of Artificial Sequence: Synthetic peptide"
DYYMY

SEQ ID NO: 166 - protein, 5 aa, Artificial Sequence
  source: /note="Description of Artificial Sequence: Synthetic peptide"
TYSMN

SEQ ID NO: 167 - protein, 19 aa, Artificial Sequence
  source: /note="Description of Artificial Sequence: Synthetic peptide"
RIKSKTDGGTTDYAAPVKG

SEQ ID NO: 168 - protein, 19 aa, Artificial Sequence
  source: /note="Description of Artificial Sequence: Synthetic peptide"
RIKSKTDGGTTDYTAPVKG

SEQ ID NO: 169 - protein, 17 aa, Artificial Sequence
  source: /note="Description of Artificial Sequence: Synthetic peptide"
VISFDGSIKYSVDSVKG

SEQ ID NO: 170 - protein, 17 aa, Artificial Sequence
  source: /note="Description of Artificial Sequence: Synthetic peptide"
VIWYDGSNKYYADSVKG

SEQ ID NO: 171 - protein, 17 aa, Artificial Sequence
  source: /note="Description of Artificial Sequence: Synthetic peptide"
VIWYDGSNKYYAESVKG

SEQ ID NO: 172 - protein, 19 aa, Artificial Sequence
  source: /note="Description of Artificial Sequence: Synthetic peptide"
RIKSTTDGGTTDYAAPVKG

SEQ ID NO: 173 - protein, 17 aa, Artificial Sequence
  source: /note="Description of Artificial Sequence: Synthetic peptide"
AISGSGGRTYYADSVKG

SEQ ID NO: 174 - protein, 17 aa, Artificial Sequence
  source: /note="Description of Artificial Sequence: Synthetic peptide"
WINPNSGGTNYAQKFQG

SEQ ID NO: 175 - protein, 17 aa, Artificial Sequence
  source: /note="Description of Artificial Sequence: Synthetic peptide"
VISYDGSHESYADSVKG

SEQ ID NO: 176 - protein, 19 aa, Artificial Sequence
  source: /note="Description of Artificial Sequence: Synthetic peptide"
FIRSRAYGGTPEYAASVKG

SEQ ID NO: 177 - protein, 17 aa, Artificial Sequence
  source: /note="Description of Artificial Sequence: Synthetic peptide"
WISPNSGGTNYAQKFQG

SEQ ID NO: 178 - protein, 17 aa, Artificial Sequence
  source: /note="Description of Artificial Sequence: Synthetic peptide"
SISSSSSYRYYADSVKG

SEQ ID NO: 179 - protein, 20 aa, Artificial Sequence
  source: /note="Description of Artificial Sequence: Synthetic peptide"
DRTGYSISWSSYYYYYGMDV

SEQ ID NO: 180 - protein, 21 aa, Artificial Sequence
  source: /note="Description of Artificial Sequence: Synthetic peptide"
DRLNYYDSSGYYHYKYYGMAV

SEQ ID NO: 181 - protein, 21 aa, Artificial Sequence
  source: /note="Description of Artificial Sequence: Synthetic peptide"
DRLNYYESSGYYHYKYYGMAV

SEQ ID NO: 182 - protein, 17 aa, Artificial Sequence
  source: /note="Description of Artificial Sequence: Synthetic peptide"
AGGIAAAGLYYYYGMDV

SEQ ID NO: 183 - protein, 21 aa, Artificial Sequence
  source: /note="Description of Artificial Sequence: Synthetic peptide"
DQREVGPYSSGWYDYYYGMDV

SEQ ID NO: 184 - protein, 21 aa, Artificial Sequence
  source: /note="Description of Artificial Sequence: Synthetic peptide"
DQMSIIMLRGVFPPYYYGMDV

SEQ ID NO: 185 - protein, 20 aa, Artificial Sequence
  source: /note="Description of Artificial Sequence: Synthetic peptide"
ERKRVTMSTLYYYFYYGMDV

SEQ ID NO: 186 - protein, 10 aa, Artificial Sequence
  source: /note="Description of Artificial Sequence: Synthetic peptide"
GRGIAARWDY

SEQ ID NO: 187 - protein, 18 aa, Artificial Sequence
  source: /note="Description of Artificial Sequence: Synthetic peptide"
GGYSGYAGLYSHYYGMDV

SEQ ID NO: 188 - protein, 22 aa, Artificial Sequence
  source: /note="Description of Artificial Sequence: Synthetic peptide"
EGVSGSSPYSISWYDYYYGMDV

SEQ ID NO: 189 - protein, 21 aa, Artificial Sequence
  source: /note="Description of Artificial Sequence: Synthetic peptide"
DRLNYYDSSGYYHYKYYGLAV

SEQ ID NO: 190 - protein, 131 aa, Artificial Sequence
  source: /note="Description of Artificial Sequence: Synthetic polypeptide"
EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYFCTTDRTGYSISWSSYYYYYGMDVWGQGTTVTVSS

SEQ ID NO: 191 - protein, 131 aa, Artificial Sequence
  source: /note="Description of Artificial Sequence: Synthetic polypeptide"
EVQLVESGGGLVKPGGSLRLSCAASGFTFGNAWMSWVRQAPGKELEWVGRIKSKTDGGTTDYAAPVKGRFTISRDDSKNTLYLQMNSLKTEDTAVYFCTTDRTGYSISWSSYYYYYGMDVWGQGTTVTVSS

SEQ ID NO: 192 - protein, 131 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSISWSSYYYYYGMDVWGQGTTVTVSS

SEQ ID NO: 193 - protein, 131 aa, Artificial Sequence
  source: /note="Description of Artificial Sequence: Synthetic polypeptide"
EVQLVESGGGLVKPGGSLRLSCAASGFTFSNAWMSWVRQAPGKELEWVGRIKSKTDGGTTDYTAPVKGRFTISRDDSKNTLYLQMNSLKAEDTAVYYCTTDRTGYSISWSSYYYYYGMDVWGQGTTVTVSS

SEQ ID NO: 194 - protein, 130 aa, Artificial Sequence [sequence omitted]

SEQ ID NO: 195 - protein, 130 aa, Artificial Sequence
  source: /note="Description of Artificial Sequence: Synthetic polypeptide"
QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYDSSGYYHYKYYGMAVWGQGTTVTVSS

SEQ ID NO: 196 - protein, 130 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 197 - protein, 130 aa, Artificial Sequence
  source: /note="Description of Artificial Sequence: Synthetic polypeptide"
QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 198 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSS

SEQ ID NO: 199 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKELEWVAVIWYDGSNKYYADSVKGRFIISRDKSKNTLYLQMNSLRAEDTAVYYCARAGGIAAAGLYYYYGMDVWGQGTTVTVSS

SEQ ID NO: 200 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYAESVKGRFIISRDKSKNTLYLQMNSLRAEDTAVYYCARAGGIAAAGLYYYYGMDVWGQGTTVTVSS

SEQ ID NO: 201 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKELEWVAVIWYDGSNKYYAESVKGRFIISRDKSKNTLYLQMNSLRAEDTAVYYCARAGGIAAAGLYYYYGMDVWGQGTTVTVSS

SEQ ID NO: 202 - protein, 131 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSTTDGGTTDYAAPVKGRFTISRDDSKNTLYLQMNSLKTEDTAVYYCTTDRTGYSISWSSYYYYYGMDVWGQGTTVTVSS

SEQ ID NO: 203 - protein, 130 aa, Artificial Sequence
  source: /note="Description of Artificial Sequence: Synthetic polypeptide"
EVQLLESGGGLVQPGESLRLSCAASGFTFSSYAMSWVRQAPGKGLEWVSAISGSGGRTYYADSVKGRFTISRDNSKNTLYLQMNSLRAEDTAVYYCAKDQREVGPYSSGWYDYYYGMDVWGQGTTVTVSS

SEQ ID NO: 204 - protein, 130 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYFCARDQMSIIMLRGVFPPYYYGMDVWGQGTTVTVSS

SEQ ID NO: 205 - protein, 129 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSHESYADSVKGRFTISRDISKNTLYLQMNSLRAEDTAVYFCARERKRVTMSTLYYYFYYGMDVWGQGTTVTVSS

SEQ ID NO: 206 - protein, 121 aa, Artificial Sequence
  source: /note="Description of Artificial Sequence: Synthetic polypeptide"
EVQLVESGGGLVKPGRSLRLSCTASGFTFGDYAMSWFRQAPGKGLEWIGFIRSRAYGGTPEYAASVKGRFTISRDDSKTIAYLQMNSLKTEDTAVYFCARGRGIAARWDYWGQGTLVTVSS

SEQ ID NO: 207 - protein, 127 aa, Artificial Sequence
  source: /note="Description of Artificial Sequence: Synthetic polypeptide"
QVQLVQSGAEVKKPGASVKVSCKASGYTFTDYYMYWVRQAPGQGLEWMGWISPNSGGTNYAQKFQGRVTMTRDTSISTAYMELSRLRSDDTAVYYCVRGGYSGYAGLYSHYYGMDVWGQGTTVTVSS

SEQ ID NO: 208 - protein, 131 aa, Artificial Sequence
  source: /note="Description of Artificial Sequence: Synthetic polypeptide"
EVQLVESGGGLVKPGGSLRLSCAASGYTFSTYSMNWVRQAPGKGLEWVSSISSSSSYRYYADSVKGRFTISRDNAKNSLYLQMSSLRAEDTAVYYCAREGVSGSSPYSISWYDYYYGMDVWGQGTTVTVSS

SEQ ID NO: 209 - protein, 131 aa, Artificial Sequence
  source: /note="Description of Artificial Sequence: Synthetic polypeptide"
EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYYCTTDRTGYSISWSSYYYYYGMDVWGQGTTVTVSS

SEQ ID NO: 210 - protein, 130 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGLAVWGQGTTVTVSS

SEQ ID NO: 211 - protein, 214 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 212 - protein, 214 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGEGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 213 - protein, 214 aa, Artificial Sequence
  source: /note="Description of Artificial Sequence: Synthetic polypeptide"
DIQMTQSPSSLSASVGDRITITCRASQSISRYLNWYQQKPGKAPKLLIYAASSLQSGIPSRFSGSGSGTDFTLTINSLQPEDFATYFCQQSYSPPFTFGQGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 214 - protein, 214 aa, Artificial Sequence
  source: /note="Description of Artificial Sequence: Synthetic polypeptide"
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 215 - protein, 214 aa, Artificial Sequence
  source: /note="Description of Artificial Sequence: Synthetic polypeptide"
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGEGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 216 - protein, 214 aa, Artificial Sequence
  source: /note="Description of Artificial Sequence: Synthetic polypeptide"
EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 217 - protein, 214 aa, Artificial Sequence
  source: /note="Description of Artificial Sequence: Synthetic polypeptide"
EIVLTQSPATLSLSPGERATLSCRASQSVGRSLHWYQQKPGQAPRLLIKYASQSLSGIPARFSGSGSGTDFTLTISSLEPEDFAVYYCHQSSRLPFTFGEGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 218 - protein, 220 aa, Artificial Sequence
  source: /note="Description of Artificial Sequence: Synthetic polypeptide"
DIVMTQSPDSLAVSLGERATIHCKSSQSVLYSSNNKNFLTWYQQKPGQPPKLLIYRASTRESGVPDRFSGSGSGTDFTLTISSLQAEDVAVYFCQQYYSAPFTFGPGTRVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 219 - protein, 220 aa, Artificial Sequence
  source: /note="Description of Artificial Sequence: Synthetic polypeptide"
DIVMTQSPDSLAVSLGERATIHCKSSQSVLYSSNNKNFLTWYQQKPGQPPKLLIYRASTRESGVPDRFSGSGSGTDFTLTISSLQAEDVAVYFCQQYYSAPFTFGEGTRVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 220 - protein, 220 aa, Artificial Sequence
  source: /note="Description of Artificial Sequence: Synthetic polypeptide"
DIVMTQSPDSLAVSLGERATINCKSSQSVLYSSNNKNFLTWYQQKPGQPPKLLIYRASTRESGVPDRFSGSGSGTDFTLTISSLQAEDVAVYFCQQYYSAPFTFGPGTRVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 221 - protein, 220 aa, Artificial Sequence
  source: /note="Description of Artificial Sequence: Synthetic polypeptide"
DIVMTQSPDSLAVSLGERATINCKSSQSVLYSSNNKNFLTWYQQKPGQPPKLLIYRASTRESGVPDRFSGSGSGTDFTLTISSLQAEDVAVYFCQQYYSAPFTFGEGTRVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 222 - DNA, 642 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - DNA, 642 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggcgaggggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 224 - DNA, 642 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggccaggggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 225 - DNA, 642 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 226 - DNA, 642 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggcgaggggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 227 - DNA, 642 bp, Artificial Sequence
  source: /note="Description of Artificial Sequence: Synthetic polynucleotide"
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 228 - DNA, 642 bp, Artificial Sequence
  source: /note="Description of Artificial Sequence: Synthetic polynucleotide"
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggagaagggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 229 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatccactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggccctgggaccagagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 230 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatccactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggcgaggggaccagagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggccctgggaccagagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggcgaggggaccagagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - protein, 453 aa, Artificial Sequence
  source: /note="Description of Artificial Sequence: Synthetic polypeptide"
QVQLQQSGPGLVKPSQTLSLTCAISGDSVSSNSATWNWIRQSPSRGLEWLGRTYYRSKWSNHYAVSVKSRITINPDTSKSQFSLQLNSVTPEDTAVYYCARGTWKQLWFLDHWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 234 - protein, 453 aa, Artificial Sequence
  source: /note="Description of Artificial Sequence: Synthetic polypeptide"
QVQLQQSGPGLVKPSQTLSLTCAISGDSVSSNSATWNWIRQSPSRKLEWLGRTYYRSKWSNHYAVSVKSRITINPDTSKSQFSLQLNSVTPEDTAVYYCARGTWKQLWFLDHWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 235 - protein, 453 aa, Artificial Sequence
  source: /note="Description of Artificial Sequence: Synthetic polypeptide"
QVQLQQSGPGLVKPSQTLSLTCAISGDSVSSNSATWNWIRQSPSRGLEWLGRTYYRSKWSNHYAVSVKSRITINPDTSKSQFSLQLNSVTPEDTAVYYCARGTWKQLWFLDHWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 236 - protein, 449 aa, Artificial Sequence
  source: /note="Description of Artificial Sequence: Synthetic polypeptide"
QVQLQQSGPGLVKPSQTLSLTCAISGDSVSSNSATWNWIRQSPSRGLEWLGRTYYRSKWSNHYAVSVKSRITINPDTSKSQFSLQLNSVTPEDTAVYYCARGTWKQLWFLDHWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVDGFYPSDIAVEWESNGQPENNYDTTPPMLDSDGSFFLYSDLTVDKSRWQQGNVFSCSVMHEALHNHYTQKSLSLSPGK

SEQ ID NO: 237 - protein, 450 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 238 - protein, 450 aa, Artificial Sequence
  source: /note="Description of Artificial Sequence: Synthetic polypeptide"
QVQLVESGAEVVKPGASVKVSCKASGFTFSRFAMHWVRQAPGQKLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 239 - protein, 450 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 240 - protein, 446 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVDGFYPSDIAVEWESNGQPENNYDTTPPMLDSDGSFFLYSDLTVDKSRWQQGNVFSCSVMHEALHNHYTQKSLSLSPGK

SEQ ID NO: 241 - protein, 450 aa, Artificial Sequence
  source: /note="Description of Artificial Sequence: Synthetic polypeptide"
QVQLVESGGGVVQPGRSLRLSCAASGFTFSRFAMHWVRQAPGKGLEWVAVISYDGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 242 - protein, 450 aa, Artificial Sequence
  source: /note="Description of Artificial Sequence: Synthetic polypeptide"
QVQLVESGGGVVQPGRSLRLSCAASGFTFSRFAMHWVRQAPGKKLEWVAVISYDGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 243 - protein, 450 aa, Artificial Sequence
  source: /note="Description of Artificial Sequence: Synthetic polypeptide"
QVQLVESGGGVVQPGRSLRLSCAASGFTFSRFAMHWVRQAPGKGLEWVAVISYDGGNKYYAESVKGRFTISRDNSKNTLYLQMNSLRAEDTALFYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 244 - protein, 446 aa, Artificial Sequence
  source: /note="Description of Artificial Sequence: Synthetic polypeptide"
QVQLVESGGGVVQPGRSLRLSCAASGFTFSRFAMHWVRQAPGKGLEWVAVISYDGGNKYYAESVKGRFTISRDNSKNTLYLQMNSLRAEDTALFYCARGYDVLTGYPDYWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVDGFYPSDIAVEWESNGQPENNYDTTPPMLDSDGSFFLYSDLTVDKSRWQQGNVFSCSVMHEALHNHYTQKSLSLSPGK

SEQ ID NO: 245 - protein, 449 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGNTYYNPSLKSRVTISGDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 246 - protein, 449 aa, Artificial Sequence
  source: /note="Description of Artificial Sequence: Synthetic polypeptide"
QVQLQESGPGLVKPSQTLSLTCTVSGGSISSGGYYWSWIRQHPGKKLEWIGYIYYSGNTYYNPSLKSRVTISGDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 247 - protein, 449 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGNTYYNPSLKSRVTISGDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 248 - protein, 445 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGNTYYNPSLKSRVTISGDTSKNQFSLKLRSVTAADTAVYYCTRGGAARGMDVWGQGTTVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVDGFYPSDIAVEWESNGQPENNYDTTPPMLDSDGSFFLYSDLTVDKSRWQQGNVFSCSVMHEALHNHYTQKSLSLSPGK

SEQ ID NO: 249 - protein, 449 aa, Artificial Sequence
  source: /note="Description of Artificial Sequence: Synthetic polypeptide"
QVQLQESGPGLVKPSETLSLTCTVSGGSISSGGYYWSWIRQPPGKGLEWIGYIYYSGNTYYNPSLKSRVTISVDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 250 - protein, 449 aa, Artificial Sequence
  source: /note="Description of Artificial Sequence: Synthetic polypeptide"
QVQLQESGPGLVKPSETLSLTCTVSGGSISSGGYYWSWIRQPPGKKLEWIGYIYYSGNTYYNPSLKSRVTISVDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 251 - protein, 449 aa, Artificial Sequence
  source: /note="Description of Artificial Sequence: Synthetic polypeptide"
QVQLQESGPGLVKPSETLSLTCTVSGGSISSGGYYWSWIRQPPGKGLEWIGYIYYSGNTYYNPSLKSRVTISVDTSKNQFSLKLRSVTAADTAVYYCTRGGAARGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 252 - DNA, 1359 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 253 - DNA, 1359 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaaagcttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 254 - DNA, 1359 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 255 - DNA, 1347 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcaagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcgatggcttctaccccagcgacatcgccgtggagtgggagagcaatgggcagccggagaacaactacgataccacacctcccatgctggactccgacggctccttcttcctctacagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 256 - DNA, 1350 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 257 - DNA, 1350 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcagaagttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 258 - DNA, 1350 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 259 - DNA, 1338 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcaagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcgatggcttctaccccagcgacatcgccgtggagtgggagagcaatgggcagccggagaacaactacgataccacacctcccatgctggactccgacggctccttcttcctctacagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 260 - DNA, 1350 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 261 - DNA, 1350 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaagaagctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 262 - DNA, 1350 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 263 - DNA, 1338 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcaagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcgatggcttctaccccagcgacatcgccgtggagtgggagagcaatgggcagccggagaacaactacgataccacacctcccatgctggactccgacggctccttcttcctctacagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 264 - DNA, 1347 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 265 - DNA, 1347 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagaagctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 266 - DNA, 1347 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgataccacgcctcccgtgctggactccgacggctccttcttcctctatagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 267 - DNA, 1335 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcaagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcgatggcttctaccccagcgacatcgccgtggagtgggagagcaatgggcagccggagaacaactacgataccacacctcccatgctggactccgacggctccttcttcctctacagcgatctcaccgtggacaagagcaggtggcagcaggggaacgtcttctcatgctccgtgatgcatgaggctctgcacaaccactacacgcagaagagcctctccctgtctccgggtaaa

SEQ ID NO: 268 - DNA, 1347 bp, Artificial Sequence
  source: /note="Description of Artificial Sequence: Synthetic polynucleotide"
caggtgcagctgcaggagtcgggcccaggactggtgaagccttcagagaccctgtccctcacctgcactgtctctggtggctccatcagcagtggtggttactactggagctggatccgccagcccccagggaagggcctggagtggattgggtacatctattacagtgggaacacctactacaacccgtccctcaagagtcgagttaccatatcagtggacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 269 - DNA, 1347 bp, Artificial Sequence
  source: /note="Description of Artificial Sequence: Synthetic polynucleotide"
caggtgcagctgcaggagtcgggcccaggactggtgaagccttcagagaccctgtccctcacctgcactgtctctggtggctccatcagcagtggtggttactactggagctggatccgccagcccccagggaagaagctggagtggattgggtacatctattacagtgggaacacctactacaacccgtccctcaagagtcgagttaccatatcagtagacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 270 - DNA, 1347 bp, Artificial Sequence
  source: /note="Description of Artificial Sequence: Synthetic polynucleotide"
caggtgcagctgcaggagtcgggcccaggactggtgaagccttcagagaccctgtccctcacctgcactgtctctggtggctccatcagcagtggtggttactactggagctggatccgccagcccccagggaagggcctggagtggattgggtacatctattacagtgggaacacctactacaacccgtccctcaagagtcgagttaccatatcagtggacacgtctaagaaccagttctccctgaagctgaggtctgtgactgccgcggacacggccgtgtattactgtacgagaggaggagcagctcgcggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 271 - protein, 216 aa, Artificial Sequence
  source: /note="Description of Artificial Sequence: Synthetic polypeptide"
QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 272 - protein, 216 aa, Artificial Sequence
  source: /note="Description of Artificial Sequence: Synthetic polypeptide"
QSVLTQPPSASGTPGQRVTISCSGSSSNIGSNYVYWYQQLPGAAPKLLIFRNNQRPSGVPDRFSGSKSGTSASLAISGLRSEDEADYYCAAWDDSLSGWVFGKGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 273 - protein, 216 aa, Artificial Sequence
  source: /note="Description of Artificial Sequence: Synthetic polypeptide"
QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 274 - protein, 216 aa, Artificial Sequence
  source: /note="Description of Artificial Sequence: Synthetic polypeptide"
QSVLTQSPSASGTPGQRVTISCSGSSSNIGSNYVYWYQQLPGAAPKLLILRNNQRPSGVPDRFSGSKSGTSASLTISGLRSEDEADYYCAAWDDSLSGWVFGKGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 275 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 276 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGKGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 277 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 278 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGKGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 279 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 280 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGKGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 281 - protein, 215 aa, Artificial Sequence
  source: /note="Description of Artificial Sequence: Synthetic polypeptide"
EIVLTQSPGTLSLSPGERATLSCRASQSVSSGYLTWYQQKPGQAPRLLIYGASSRATGIPDRFSGSGSGTDFTLTISRLEPEDFAVYYCQQYGNSLSRFGQGTKLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 282 - protein, 215 aa, Artificial Sequence
  source: /note="Description of Artificial Sequence: Synthetic polypeptide"
EIVLTQSPGTLSLSPGERATLSCRASQSVSSGYLTWYQQKPGQAPRLLIYGASSRATGIPDRFSGSGSGTDFTLTISRLEPEDFAVYYCQQYGNSLSRFGKGTKLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 283 - DNA, 648 bp, Artificial Sequence
  source: /note="Description of Artificial Sequence: Synthetic polynucleotide"
cagtctgtgctgactcagccaccctcagcgtctgggacccccgggcagagagtcaccatctcttgttctggaagcagctccaacatcggcagtaattatgtatactggtaccagcagctcccaggagcggcccccaaactcctcatctttaggaataatcagcggccctcaggggtccctgaccgcttctctggctccaagtctggcacctcagcctccctggccatcagtgggctccggtccgaggatgaggctgattattactgtgcagcatgggatgacagcctgagtggttgggtgttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 284 - DNA, 648 bp, Artificial Sequence
  source: /note="Description of Artificial Sequence: Synthetic polynucleotide"
cagtctgtgctgactcagccaccctcagcgtctgggacccccgggcagagagtcaccatctcttgttctggaagcagctccaacatcggcagtaattatgtatactggtaccagcagctcccaggagcggcccccaaactcctcatctttaggaataatcagcggccctcaggggtccctgaccgcttctctggctccaagtctggcacctcagcctccctggccatcagtgggctccggtccgaggatgaggctgattattactgtgcagcatgggatgacagcctgagtggttgggtgttcggcaaggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 285 - DNA, 648 bp, Artificial Sequence
  source: /note="Description of Artificial Sequence: Synthetic polynucleotide"
cagtctgtgctgactcagtcaccctcagcgtctgggacccccgggcagagagtcaccatctcttgttctggaagcagctccaacatcggcagtaattatgtatactggtaccagcagctcccaggagcggcccccaaactcctcatccttaggaataatcagcggccctcaggggtccctgaccgattctctggctccaagtctggcacctcagcctccctgaccatcagtgggctccggtccgaggatgaggctgactattattgtgcagcatgggatgacagcctgagtggttgggtgttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 286 - DNA, 648 bp, Artificial Sequence
  source: /note="Description of Artificial Sequence: Synthetic polynucleotide"
cagtctgtgctgactcagtcaccctcagcgtctgggacccccgggcagagagtcaccatctcttgttctggaagcagctccaacatcggcagtaattatgtatactggtaccagcagctcccaggagcggcccccaaactcctcatccttaggaataatcagcggccctcaggggtccctgaccgattctctggctccaagtctggcacctcagcctccctgaccatcagtgggctccggtccgaggatgaggctgactattattgtgcagcatgggatgacagcctgagtggttgggtgttcggcaaggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 287 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 288 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcaaggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 289 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 290 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcaaggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 291 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 292 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcaaggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 293 - DNA, 645 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcggctacttaacctggtaccagcagaaacctggccaggctcccagactcctcatctatggtgcatccagcagggccactggcatcccagacaggttcagtggcagtgggtctgggacggacttcactctcaccatcagcagactggagcctgaagattttgcagtgtattactgtcagcagtatggtaactcactgagcaggtttggccaggggaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 294 - DNA, 645 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcggctacttaacctggtaccagcagaaacctggccaggctcccagactcctcatctatggtgcatccagcagggccactggcatcccagacaggttcagtggcagtgggtctggtacggacttcactctcaccatcagcagactggagcctgaagattttgcagtgtattactgtcagcagtatggtaactcactgagcaggtttggcaaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 295 - protein, 461 aa, Artificial Sequence
  source: /note="Description of Artificial Sequence: Synthetic polypeptide"
EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYFCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 296 - protein, 461 aa, Artificial Sequence
  source: /note="Description of Artificial Sequence: Synthetic polypeptide"
EVQLVESGGGLVKPGGSLRLSCAASGFTFGNAWMSWVRQAPGKELEWVGRIKSKTDGGTTDYAAPVKGRFTISRDDSKNTLYLQMNSLKTEDTAVYFCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 297 - protein, 461 aa, Artificial Sequence
  source: /note="Description of Artificial Sequence: Synthetic polypeptide"
EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYFCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 298 - protein, 457 aa, Artificial Sequence
  source: /note="Description of Artificial Sequence: Synthetic polypeptide"
EVQLVESGGGLVKPGGSLRLSCAASGFTFGNAWMSWVRQAPGKGLEWVGRIKSKTDGGTTDYAAPVKGRFTISRDDSKNTLYLQMNSLKTEDTAVYFCTTDRTGYSISWSSYYYYYGMDVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 299 - protein, 461 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 300 - protein, 461 aa, Artificial Sequence
  source: /note="Description of Artificial Sequence: Synthetic polypeptide"
EVQLVESGGGLVKPGGSLRLSCAASGFTFSNAWMSWVRQAPGKELEWVGRIKSKTDGGTTDYTAPVKGRFTISRDDSKNTLYLQMNSLKAEDTAVYYCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 301 - protein, 461 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSISWSSYYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 302 - protein, 457 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYTAPVKGRFTISRDDSKNTLYLQMNSLKAEDTAVYYCTTDRTGYSISWSSYYYYYGMDVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 303 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 304 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 305 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 306 - protein, 456 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 307 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 308 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKELEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 309 - protein, 460 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 310 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 311 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKELEWVAVIWYDGSNKYYADSVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 312 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 313 - protein, 452 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFIISRDKSKNTLYLQMNSLRAEDTAVYYCARAGGIAAAGLYYYYGMDVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 314 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYAESVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 315 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKELEWVAVIWYDGSNKYYAESVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 316 - protein, 456 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYAESVKGRFIISRDKSKNTLYLQMNSLRAEDTAVYYCARAGGIAAAGLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 317 - DNA, 1383 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 318 - DNA, 1383 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggagctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 319 - DNA, 1383 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 320 - DNA, 1371 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctggagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccggaagaagatgaccaagaaccaggtcagcctgacctgcctggtcaaaggcttctaccccagcgacatcgccgtggagtgggagagcaatgggcagccggagaacaactacaagaccacacctcccatgctgaagtccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 321 - DNA, 1383 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 322 - DNA, 1383 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggagctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 323 - DNA, 1383 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 324 - DNA, 1371 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaaggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctggagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccggaagaagatgaccaagaaccaggtcagcctgacctgcctggtcaaaggcttctaccccagcgacatcgccgtggagtgggagagcaatgggcagccggagaacaactacaagaccacacctcccatgctgaagtccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 325 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtaaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 326 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccagggaaggagctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 327 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 328 - DNA, 1368 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctggagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccggaagaagatgaccaagaaccaggtcagcctgacctgcctggtcaaaggcttctaccccagcgacatcgccgtggagtgggagagcaatgggcagccggagaacaactacaagaccacacctcccatgctgaagtccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 329 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtaaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 330 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccagggaaggagctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 331 - DNA, 1380 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 333 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccagggaaggagctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 334 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggttgacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 335 - DNA, 1356 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctggagagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccggaagaagatgaccaagaaccaggtcagcctgacctgcctggtcaaaggcttctaccccagcgacatcgccgtggagtgggagagcaatgggcagccggagaacaactacaagaccacacctcccatgctgaagtccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 336 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagagtccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 337 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccagggaaggagctggagtgggtggcagttatatggtatgatggaagtaataaatactatgcagagtccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 338 - DNA, 1368 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagagtccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggttgacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 339 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 340 - protein, 472 aa, Homo sapiens
MLYSIFHFGLMMEKKCTLYFLVLLPFFMILVTAELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLLGIEFVLIPWRPEGKIAEEVYDYIMHILMHFQGLLVSTIFCFFNGEVQAILRRNWNQYKIQFGNSFSNSEALRSASYTVSTISDGPGYSHDCPSEHLNGKSIHDIENVLLKPENLYN

SEQ ID NO: 341 - protein, 148 aa, Homo sapiens
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 342 - protein, 116 aa, Homo sapiens
ELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTA

SEQ ID NO: 343 - protein, 91 aa, Homo sapiens
CQEANYGALLRELCLTQFQVDMEAVGETLWCDWGRTIRSYRELADCTWHMAEKLGCFWPNAEVDRFFLAVHGRYFRSCPISGRAVRDPPGS

SEQ ID NO: 344 - protein, 17 aa, Homo sapiens
DSIQLGVTRNKIMTAQY

SEQ ID NO: 345 - protein, 13 aa, Homo sapiens
DVAAGTESMQLCP

SEQ ID NO: 346 - protein, 25 aa, Homo sapiens
DGNWFRHPASNRTWTNYTQCNVNTH

SEQ ID NO: 347 - protein, 8 aa, Homo sapiens
ECYQKIMQ

SEQ ID NO: 348 - protein, 7 aa, Homo sapiens
DGWLCWN

SEQ ID NO: 349 - protein, 12 aa, Homo sapiens
RELADCTWHMAE

SEQ ID NO: 350 - protein, 13 aa, Homo sapiens
DWGRTIRSYRELA

SEQ ID NO: 351 - protein, 9 aa, Homo sapiens
ELCLTQFQV

SEQ ID NO: 352 - protein, 7 aa, Homo sapiens
DCTWHMA

SEQ ID NO: 353 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 354 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 355 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 356 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 357 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 358 - protein, 330 aa, Homo sapiens [sequence omitted]

SEQ ID NO: 359 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 362 - protein, 4 aa, Artificial Sequence
  source: /note="Description of Artificial Sequence: Synthetic peptide"
GGGG

SEQ ID NO: 363 - protein, 5 aa, Artificial Sequence
  source: /note="Description of Artificial Sequence: Synthetic peptide"
GGGGG

SEQ ID NO: 364 - protein, 7 aa, Artificial Sequence
  source: /note="Description of Artificial Sequence: Synthetic peptide"
GGGGGGG

SEQ ID NO: 365 - protein, 5 aa, Artificial Sequence
  source: /note="Description of Artificial Sequence: Synthetic peptide"
GGGGS

SEQ ID NO: 366 - protein, 5 aa, Artificial Sequence
  source: /note="Description of Artificial Sequence: Synthetic peptide"
GGGGS

SEQ ID NO: 367 - protein, 9 aa, Artificial Sequence
  source: /note="Description of Artificial Sequence: Synthetic peptide"
GGGSGGGGS

SEQ ID NO: 368 - protein, 10 aa, Artificial Sequence
  source: /note="Description of Artificial Sequence: Synthetic peptide"
GGGGSGGGGS

SEQ ID NO: 369 - protein, 15 aa, Artificial Sequence
  source: /note="Description of Artificial Sequence: Synthetic peptide"
GGGGSGGGGSGGGGS

SEQ ID NO: 370 - protein, 25 aa, Artificial Sequence
  source: /note="Description of Artificial Sequence: Synthetic peptide"
GGGGSGGGGSGGGGSGGGGSGGGGS

SEQ ID NO: 371 - protein, 6 aa, Artificial Sequence
  source: /note="Description of Artificial Sequence: Synthetic peptide"
GGGGGK

SEQ ID NO: 372 - protein, 7 aa, Artificial Sequence
  source: /note="Description of Artificial Sequence: Synthetic peptide"
GGGGGKR

SEQ ID NO: 373 - protein, 8 aa, Artificial Sequence
  source: /note="Description of Artificial Sequence: Synthetic peptide"
GGGKGGGG

SEQ ID NO: 374 - protein, 8 aa, Artificial Sequence
  source: /note="Description of Artificial Sequence: Synthetic peptide"
GGGNGSGG

SEQ ID NO: 375 - protein, 8 aa, Artificial Sequence
  source: /note="Description of Artificial Sequence: Synthetic peptide"
GGGCGGGG

SEQ ID NO: 376 - protein, 5 aa, Artificial Sequence
  source: /note="Description of Artificial Sequence: Synthetic peptide"
GPNGG

SEQ ID NO: 377 - protein, 6 aa, Artificial Sequence
  source: /note="Description of Artificial Sequence: Synthetic peptide"
GGEGGG

SEQ ID NO: 378 - protein, 8 aa, Artificial Sequence
  source: /note="Description of Artificial Sequence: Synthetic peptide"
GGEEEGGG

SEQ ID NO: 379 - protein, 5 aa, Artificial Sequence
  source: /note="Description of Artificial Sequence: Synthetic peptide"
GEEEG

SEQ ID NO: 380 - protein, 4 aa, Artificial Sequence
  source: /note="Description of Artificial Sequence: Synthetic peptide"
GEEE

SEQ ID NO: 381 - protein, 6 aa, Artificial Sequence
  source: /note="Description of Artificial Sequence: Synthetic peptide"
GGDGGG

SEQ ID NO: 382 - protein, 7 aa, Artificial Sequence
  source: /note="Description of Artificial Sequence: Synthetic peptide"
GGDDDGG

SEQ ID NO: 383 - protein, 5 aa, Artificial Sequence
  source: /note="Description of Artificial Sequence: Synthetic peptide"
GDDDG

SEQ ID NO: 384 - protein, 4 aa, Artificial Sequence
  source: /note="Description of Artificial Sequence: Synthetic peptide"
GDDD

SEQ ID NO: 385 - protein, 21 aa, Artificial Sequence
  source: /note="Description of Artificial Sequence: Synthetic peptide"
GGGGSDDSDEGSDGEDGGGGS

SEQ ID NO: 386 - protein, 5 aa, Artificial Sequence
  source: /note="Description of Artificial Sequence: Synthetic peptide"
WEWEW

SEQ ID NO: 387 - protein, 5 aa, Artificial Sequence
  source: /note="Description of Artificial Sequence: Synthetic peptide"
FEFEF

SEQ ID NO: 388 - protein, 6 aa, Artificial Sequence
  source: /note="Description of Artificial Sequence: Synthetic peptide"
EEEWWW

SEQ ID NO: 389 - protein, 6 aa, Artificial Sequence
  source: /note="Description of Artificial Sequence: Synthetic peptide"
EEEFFF

SEQ ID NO: 390 - protein, 7 aa, Artificial Sequence
  source: /note="Description of Artificial Sequence: Synthetic peptide"
WWEEEWW

SEQ ID NO: 391 - protein, 7 aa, Artificial Sequence
  source: /note="Description of Artificial Sequence: Synthetic peptide"
FFEEEFF

SEQ ID NO: 392 - protein, 214 aa, Artificial Sequence
  source: /note="Description of Artificial Sequence: Synthetic polypeptide"
DIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 393 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 394 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 395 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 396 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKCLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGCGTKLTVL

SEQ ID NO: 397 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGGGGSGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSS

SEQ ID NO: 398 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVLGGGGSGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSS

SEQ ID NO: 399 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVLGGGGSGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 400 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGGGGSGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSS

SEQ ID NO: 401 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGGGGSGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSS

SEQ ID NO: 402 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVL

SEQ ID NO: 403 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVL

SEQ ID NO: 404 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKCLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGCGTKLTVL

SEQ ID NO: 405 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGGGTKLTVL

SEQ ID NO: 406 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGGGTKLTVL

SEQ ID NO: 407 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKCLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLAITGLQTGDEADYYCGTWDSRLSAVVFGCGTKLTVL

SEQ ID NO: 408 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKCLEWVAVISFDGSIKYSVDSVKGRFTISRDNSKNTLFLQMNSLRAEDTAVYYCARDRLNYYESSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSRLSAVVFGCGTKLTVL

SEQ ID NO: 409 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKCLEWVAVISFDGSIKYSVDSVKGRFTISRDNSKNTLFLQMNSLRAEDTAVYYCARDRLNYYESSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGCGTKLTVL

SEQ ID NO: 410 - protein, 713 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVL

SEQ ID NO: 411 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRGGGGSGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSS

SEQ ID NO: 412 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRGGGGSGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSS

SEQ ID NO: 413 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSGGGGSGGGGSGGGGSDIQLTQSPSFLSASVGDRVTITCRASQSIGRSLHWYQQKPGKCPKLLIKYASQSLSGVPSRFSGSGSGTEFTLTISSLQPEDFATYYCHQSSRLPFTFGCGTKVDIKR

SEQ ID NO: 414 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSGGGGSGGGGSGGGGSDIQLTQSPSFLSASVGDRVTITCRASQSIGRSLHWYQQKPGKCPKLLIKYASQSLSGVPSRFSGSGSGTEFTLTISSLQPEDFATYYCHQSSRLPFTFGCGTKVDIKR

SEQ ID NO: 415 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSGGGGSGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKR

SEQ ID NO: 416 - protein, 711 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSGGGGSGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKR

SEQ ID NO: 417 - protein, 711 aa, Artificial Sequence; identical to SEQ ID NO: 413
  source: /note="Description of Artificial Sequence: Synthetic polypeptide"

SEQ ID NO: 418 - protein, 711 aa, Artificial Sequence; identical to SEQ ID NO: 414
  source: /note="Description of Artificial Sequence: Synthetic polypeptide"

SEQ ID NO: 419 - protein, 711 aa, Artificial Sequence; identical to SEQ ID NO: 415
  source: /note="Description of Artificial Sequence: Synthetic polypeptide"

SEQ ID NO: 420 - protein, 711 aa, Artificial Sequence; identical to SEQ ID NO: 416
  source: /note="Description of Artificial Sequence: Synthetic polypeptide"

SEQ ID NO: 421 - protein, 711 aa, Artificial Sequence; identical to SEQ ID NO: 412
  source: /note="Description of Artificial Sequence: Synthetic polypeptide"

SEQ ID NO: 422 - protein, 711 aa, Artificial Sequence; identical to SEQ ID NO: 414
  source: /note="Description of Artificial Sequence: Synthetic polypeptide"

SEQ ID NO: 423 - protein, 711 aa, Artificial Sequence; identical to SEQ ID NO: 416
  source: /note="Description of Artificial Sequence: Synthetic polypeptide"

SEQ ID NO: 424 - protein, 711 aa, Artificial Sequence; identical to SEQ ID NO: 411
  source: /note="Description of Artificial Sequence: Synthetic polypeptide"

SEQ ID NO: 425 - protein, 711 aa, Artificial Sequence; identical to SEQ ID NO: 412
  source: /note="Description of Artificial Sequence: Synthetic polypeptide"

SEQ ID NO: 426 - protein, 214 aa, Artificial Sequence
  source: /note="Description of Artificial Sequence: Synthetic polypeptide"
DIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 427 - protein, 216 aa, Artificial Sequence
  source: /note="Description of Artificial Sequence: Synthetic polypeptide"
QSVLTQPPSVSAAPGQKVTISCSGSSSNIGNNYVSWYQKLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 428 - protein, 666 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKV

SEQ ID NO: 429 - protein, 666 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQKLPGTAPKLLIYDNNKRPSGIPDRFSGSKSGTSTTLGITGLQTGDEADYYCGTWDSRLSAVVFGGGTKLTVLASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKV

SEQ ID NO: 430 - protein, 666 aa, Artificial Sequence; identical to SEQ ID NO: 428
  source: /note="Description of Artificial Sequence: Synthetic polypeptide"

SEQ ID NO: 431 - protein, 666 aa, Artificial Sequence; identical to SEQ ID NO: 429
  source: /note="Description of Artificial Sequence: Synthetic polypeptide"

SEQ ID NO: 432 - protein, 674 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 433 - protein, 674 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQKLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 434 - protein, 674 aa, Artificial Sequence; identical to SEQ ID NO: 433
  source: /note="Description of Artificial Sequence: Synthetic polypeptide"

SEQ ID NO: 435 - protein, 674 aa, Artificial Sequence; identical to SEQ ID NO: 432
  source: /note="Description of Artificial Sequence: Synthetic polypeptide"

SEQ ID NO: 436 - protein, 674 aa, Artificial Sequence
  source: /note="Description of Artificial Sequence: Synthetic polypeptide"
QVQLVESGAEVVKPGASVKVSCKASGFTFSRFAMHWVRKAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 437 - protein, 674 aa, Artificial Sequence
  source: /note="Description of Artificial Sequence: Synthetic polypeptide"
QVQLVESGAEVVKPGASVKVSCKASGFTFSRFAMHWVRKAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQSVLTQPPSVSAAPGQKVTISCSGSSSNIGNNYVSWYQKLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECS

SEQ ID NO: 438 - protein, 674 aa, Artificial Sequence; identical to SEQ ID NO: 436
  source: /note="Description of Artificial Sequence: Synthetic polypeptide"

SEQ ID NO: 439 - protein, 674 aa, Artificial Sequence; identical to SEQ ID NO: 437
  source: /note="Description of Artificial Sequence: Synthetic polypeptide"

SEQ ID NO: 440 - protein, 674 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 441 - protein, 674 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 442 - protein, 674 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 443 - protein, 674 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 444 - protein, 682 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 445 - protein, 682 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 446 - protein, 682 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 447 - protein, 682 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 448 - protein, 682 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 449 - protein, 682 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 450 - protein, 682 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQQKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 451 - protein, 682 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSDIQLTQSPSFLSASVGDRVTITCRASQSIGRSLHWYQEKPGKAPKLLIKYASQSLSGVPSRFSGSGSGTEFTLTISSLQPEDFATYYCHQSSRLPFTFGPGTKVDIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 452 - protein, 236 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSGQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 453 - protein, 236 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYDSSGYYHYKYYGMAVWGQGTTVTVSSGQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 454 - protein, 236 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSGQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 455 - protein, 236 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYESSGYYHYKYYGMAVWGQGTTVTVSSGQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 456 - protein, 228 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 457 - protein, 228 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 458 - protein, 228 aa, Artificial Sequence
  source: /note="Description of Artificial Sequence: Synthetic polypeptide"
QVQLVESGGGVVQPGRSLRLSCAASGFTFSSFGMHWVREAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 459 - protein, 228 aa, Artificial Sequence
  source: /note="Description of Artificial Sequence: Synthetic polypeptide"
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYESSGYYHYKYYGMAVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKV

SEQ ID NO: 460 - protein, 226 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 461 - protein, 226 aa, Artificial Sequence
  source: /note="Description of Artificial Sequence: Synthetic polypeptide"
QVQLVESGAEVVKPGASVKVSCKASGFTFSRFAMHWVRKAPGQGLEWMGVISYDGGNKYYAESVKGRVTMTRDTSTSTLYMELSSLRSEDTAVYYCARGYDVLTGYPDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 462 - protein, 218 aa, Artificial Sequence
  source: /note="Description of Artificial Sequence: Synthetic polypeptide"
QVQLVESGAEVVKPGASVKVSCKASGFTFSRFAMHWVRQAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKV

SEQ ID NO: 463 - protein, 218 aa, Artificial Sequence
  source: /note="Description of Artificial Sequence: Synthetic polypeptide"
QVQLVESGAEVVKPGASVKVSCKASGFTFSRFAMHWVRKAPGQGLEWMGVISYDGGNKYYAESVKGRVTMTRDTSTSTLYMELSSLRSEDTAVYYCARGYDVLTGYPDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKV

SEQ ID NO: 464 - DNA, 324 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggccctgggaccaaagtggatatcaaacgt

SEQ ID NO: 465 - DNA, 324 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggcgaggggaccaaagtggatatcaaacgt

SEQ ID NO: 466 - DNA, 324 bp, Artificial Sequence
  source: /note="Description of Artificial Sequence: Synthetic polynucleotide"
gacatccagatgacccagtctccatcctccctgtctgcatctgtaggagacagaatcaccatcacttgccgggcaagtcagagcattagcaggtatttaaattggtatcaacagaaaccagggaaagcccctaaactcctgatctatgctgcatccagtttgcaaagtgggatcccatcaaggttcagcggcagtggatctgggacagatttcactctcaccatcaacagtctgcaacctgaagattttgcaacttacttctgtcaacagagttacagtcccccattcactttcggccaggggaccaaagtggatatcaaacgt

SEQ ID NO: 467 - DNA, 324 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgt

SEQ ID NO: 468 - DNA, 324 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggcgaggggaccaaggtggacattaagcgt

SEQ ID NO: 469 - DNA, 324 bp, Artificial Sequence
  source: /note="Description of Artificial Sequence: Synthetic polynucleotide"
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggaccagggaccaaggtggacattaagcgt

SEQ ID NO: 470 - DNA, 324 bp, Artificial Sequence
  source: /note="Description of Artificial Sequence: Synthetic polynucleotide"
gagatcgtacttactcagtcacccgccacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgctcgcttttcggggtcgggatccgggacagatttcacgctcacaatctcctcgctggaacccgaggacttcgcggtctactattgtcatcagtcatcgaggttgcctttcacgtttggagaagggaccaaggtggacattaagcgt

SEQ ID NO: 471 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatccactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggccctgggaccagagtggatatcaaacgt

SEQ ID NO: 472 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatccactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggcgaggggaccagagtggatatcaaacgt

SEQ ID NO: 473 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggccctgggaccagagtggatatcaaacgt

SEQ ID NO: 474 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagctccaacaataagaacttcttaacttggtaccagcagaaaccaggacagcctcctaaacttctcatttaccgggcatctacccgggaatccggggttcctgaccgattcagtggcagcgggtctgggacagatttcactctcaccatcagcagcctgcaggctgaagatgtggcagtttatttctgtcagcaatattatagtgctccattcactttcggcgaggggaccagagtggatatcaaacgt

SEQ ID NO: 475 - DNA, 326 bp, Artificial Sequence
  source: /note="Description of Artificial Sequence: Synthetic polynucleotide"
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttgtcagggatcccctcgaggtttagtggcagtggatctgggacacatttcaccctcaccatcaatagcctggaagctgaagatgctgcaacgtattactgtcatcagagtagtcgtttaccattcactttcggccctgggaccaaagtggatatcaaacgaac

SEQ ID NO: 476 - DNA, 325 bp, Artificial Sequence
  source: /note="Description of Artificial Sequence: Synthetic polynucleotide"
gaaattgtgctgactcagtctccagactttcagtctgtgactccaaaggagaaagtcaccatcacctgccgggccagtcagagcgttggtcgtagtttacactggtaccatcagaaaccagatcagtctccaaagctcctcatcaagtatgcttcccagtccttatcaggggtcccctcgaggttcagtggcagtggatctgggacagatttcaccctcattatcaatagcctggaagctgaagatgctgcaacgtattactgtcatcagagtagtcgtttaccattcactttcggccctgggaccaaagtggatatcaaacgaa

SEQ ID NO: 477 - DNA, 326 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcaccagaaacccggaaaggccccgaaacttctgatcaaatacgcatcacaaagcttgagcggtgtgccgtcgcgcttctccggttccggaagcggaacggaattcacgcttatcatctcctcactgcagcccgaggatttcgcgacctattactgtcaccagtcatccagactcccgtttacttttggccctgggaccaaggtggacattaagcgtac

SEQ ID NO: 478 - DNA, 326 bp, Artificial Sequence
  source: /note="Description of Artificial Sequence: Synthetic polynucleotide"
gaaattgtgctgactcagtctccagactttcagtctgtgactccaaaggagaaagtcaccatcacctgccgggccagtcagagcgttggtcgtagtttacactggtaccagcagaaaccagatcagtctccaaagctcctcatcaagtatgcttcccagtccttatcaggggtcccctcgaggttcagtggcagtggatctgggacagatttcaccctcactatcaatagcctggaagctgaagatgctgcaacgtattactgtcatcagagtagtcgtttaccattcactttcggccctgggaccaaagtggatatcaaacgaac

SEQ ID NO: 479 - DNA, 325 bp, Artificial Sequence
  source: /note="Description of Artificial Sequence: Synthetic polynucleotide"
gagatcgtacttactcagtcacccggcacattgtccctgagcccgggtgaacgggcgaccctcagctgccgagcatcccagtccgtcggacgatcattgcactggtaccaacaaaaaccgggccaggcccccagacttctgatcaagtatgcgtcacagagcttgtcgggtattcccgatcgcttttcggggtcgggatccgggacagatttcacgctcacaatctcccgactggaacccgaggacttcgcgacctactattgtcatcagtcatcgaggttgcctttcacgtttggacaggggaccaaggtggagattaagcgta

SEQ ID NO: 480 - DNA, 325 bp, Artificial Sequence
  source: /note="Description of Artificial Sequence: Synthetic polynucleotide"
gaaattgtgctgactcagtctccagactttcagtctgtgactccaaaggagaaagtcaccatcacctgccgggccagtcagagcattggtcgtagtttacactggtaccagcagaaaccagatcagtctccaaagctcctcttcaagtatgcttcccagtccttatcaggggtcccctcgaggttcagtggcagtggatctgggacagatttcaccctcacaatcaatagcctggaagctgaagatgctgcaacgtattactgtcatcagagtagtcgtttaccattcactttcggccctgggaccaaagtggatatcaaacgaa

SEQ ID NO: 481 - DNA, 326 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgttcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgtac

SEQ ID NO: 482 - DNA, 325 bp, Artificial Sequence
  source: /note="Description of Artificial Sequence: Synthetic polynucleotide"
gaaattgtgttgacgcagtcgccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtaacagtgggtctgggacagacttcactctcaccatcagcagactggagcctgaagattttgcagtgtattactgtcagaggtatggtagctcacggacgttcggccaagggaccaaggtggaaatcaaacgaa

SEQ ID NO: 483 - DNA, 339 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgctctatttgggttctaatcgggcctccggggtccctgacaggttcagtggcagtggatcaggcacagattttacactgcaaatcagcagagtggaggctgaggatgttggggtttattactgcatgcaaactctacaaactccattcactttcggccctgggaccaaagtggatatcaaacgt

SEQ ID NO: 484 - DNA, 339 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgctctatttgggttctaatcgggcctccggggtccctgacaggttcagtggcagtggatcaggcacagattttacactgaaaatcagcagagtggaggctgaggatgttggggtttattactgcatgcaaactctacaaactccattcactttcggccctgggaccaaagtggatatcaaacgt

SEQ ID NO: 485 - DNA, 327 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactgttagcaggagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgccgtgttttactgtcagcagtttggtagctcaccgtggacgttcggccaagggaccaaggtggaaatcaaacgt

SEQ ID NO: 486 - DNA, 344 bp, Artificial Sequence
  source: /note="Description of Artificial Sequence: Synthetic polynucleotide"
gacatcgtgatgacccagtctccagactccctggctgtgtctctgggcgagagggccaccatccattgcaagtccagccagaatgttttatacagctccaacaataagaacttcttaacttggtaccagcagaaaccaggacagccccctaaactgctcatttaccgggcatctacccgggaatccggggtccctgaccgattcagtggcagcgggtctgggacggatttcactctcactatcagcagtctgcaggctgaagatgtggcagtttatttctgtcagcaatattatagtgctccattcactttcggccctgggaccaaagtggatatcaaacgtac

SEQ ID NO: 487 - DNA, 343 bp, Artificial Sequence
  source: /note="Description of Artificial Sequence: Synthetic polynucleotide"
gacatcgtgatgacccagtctccagactccctggctgtgtctctgggcgagaggaccaccatcaagtgcaagtccagccagagtgttttatacagatccaacaataacaacttcttagcttggtaccagcagaaaccaggacagcctcctaagctgctcatttattgggcatctacccgggaatccggggtccctgaccgattcagtggcagcgggtctgggacagatttcactctcaccatcagcagcctgcaggctgaagatgtggctgtttatttctgtcagcaatattatatttctccgctcactttcggcggagggaccaaggtggagatcaaacgta

SEQ ID NO: 488 - DNA, 343 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagttccaacaataagcactacttagcttggtaccggcagaaaccaggacagcctcctaaactgctcatttacagggcatctacccgggaatccggggtccctgaccgattcagtggcagcgggtctgggacagatttcactctcaccatcagcagcctgcagcctgaagatgtggcagtgtattactgtcagcaatattatagttctccattcactttcggccctgggaccaaagtggatatcaaacgta

SEQ ID NO: 489 - DNA, 344 bp, Artificial Sequence
  source: /note="Description of Artificial Sequence: Synthetic polynucleotide"
gacatcgtgatgactcagtctccagactccctggctgtgtctctgggcgagagggccaccatccactgcaagtccagccagagtgttttatacagctccaacaataggaacttcttaagttggtaccagcagaaaccaggacagcctcctaaactgctcatttaccgggcatctacccgggaatccggggtccctgaccgattcagtggcagcgggtctgggacagatttcactctcaccatcagcagcctgcaggctgaagatgtggcagtttatttctgtcagcaatattatagtgctccattcactttcggccctgggaccacagtggatatcaaacgtac

SEQ ID NO: 490 - DNA, 344 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatacagttccaacaataagaactacttagcttggtaccggcagaaaccaggacagcctcctaagctgctcatttacagggcatctacccgggaatccggggtccctgaccgattcagtggcagcgggtctgggacagatttcactctcaccatcagcagcctgcaggctgaagatgtggcagtgtatcactgtcagcaatattatagttctccattcactttcggccctgggaccaaagtggatatcaaacgtac

SEQ ID NO: 491 - DNA, 369 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagt

SEQ ID NO: 492 - DNA, 369 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctacttggaactggatcaggcagtccccatcgagaaagcttgagtggctgggaaggacatattacaggtccaagtggtctaatcattatgcagtatctgtgaaaagtcgaataaccatcaaccccgacacgtccaagagccagttctccctgcagctgaactctgtgactcccgaggacacggctgtgtattactgtgcaagaggaacgtggaaacagctatggttccttgaccactggggccagggaaccctggtcaccgtctctagt

SEQ ID NO: 493 - DNA, 360 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagt

SEQ ID NO: 494 - DNA, 360 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcagaagttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagt

SEQ ID NO: 495 - DNA, 360 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 496 - DNA, 360 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaagaagctggagtgggtggcagttatatcatatgatggaggaaataaatactatgcagagtccgtgaagggccggttcaccatctccagagacaattccaagaacaccctgtatctgcaaatgaacagcctgagagctgaggacacggctctgttttactgtgcgagaggatacgatgttttgactggttaccccgactactggggccagggaaccctggtcaccgtctctagt

SEQ ID NO: 497 - DNA, 357 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagt

SEQ ID NO: 498 - DNA, 357 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagaagctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtacgagaggaggagcagctcgcggtatggacgtctggggccaagggaccacggtcaccgtctctagt

SEQ ID NO: 499 - DNA, 357 bp, Artificial Sequence
  source: /note="Description of Artificial Sequence: Synthetic polynucleotide"
caggtgcagctgcaggagtcgggcccaggactggtgaagccttcagagaccctgtccctcacctgcactgtctctggtggctccatcagcagtggtggttactactggagctggatccgccagcccccagggaagggcctggagtggattgggtacatctattacagtgggaacacctactacaacccgtccctcaagagtcgagttaccatatcagtggacacgtctaagaaccagttctccctgaagctgaggtctgtgactgccgcggacacggccgtgtattactgtacgagaggaggagcagctcgcggtatggacgtctggggccaagggaccacggtcaccgtctctagt

SEQ ID NO: 500 - DNA, 357 bp, Artificial Sequence
  source: /note="Description of Artificial Sequence: Synthetic polynucleotide"
caggtgcagctgcaggagtcgggcccaggactggtgaagccttcagagaccctgtccctcacctgcactgtctctggtggctccatcagcagtggtggttactactggagctggatccgccagcccccagggaagaagctggagtggattgggtacatctattacagtgggaacacctactacaacccgtccctcaagagtcgagttaccatatcagtagacacgtctaagaaccagttctccctgaagctgaggtctgtgactgccgcggacacggccgtgtattactgtacgagaggaggagcagctcgcggtatggacgtctggggccaagggaccacggtcaccgtctctagt

SEQ ID NO: 501 - DNA, 361 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcctctggattcaccttcagttactatgccatacactgggtccgccaggctccaggcaaggggctagagtgggtggcagttatctcatatgatggaagtaataaatactatgcagactccgtgaagggccgattcaccatctccagagacaattccaagaacacgctgtatctgcaaatgaacagcctgagagctgaggacacggctgtgtattactgtgcgagaggatacgatcttttgactggttaccccgactactggggccagggaaccctggtcaccgtctcctcag

SEQ ID NO: 502 - DNA, 362 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccgggctccaggcaaggggctggagtgggtggcagttatatcatatgatggaggaaataaatactatgcagagtccgtgaagggccggttcaccatctccagagacaattccaagaacaccctgaatctgctaatgaacagcctgagagctgaggacacggctctgttttactgtgcgagaggatacgatgttttgactggttaccccgactactggggccagggaaccctggtcaccgtctcctcagc

SEQ ID NO: 503 - DNA, 362 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgaatctgctaatgaacagcctgagagctgaggacacggctctgttttactgtgcgagaggatacgatgttttgactggttaccccgactactggggccagggaaccctggtcaccgtctcctcagc

SEQ ID NO: 504 - DNA, 360 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtagatttgccatgcactgggtccgccgggctccaggcaaggggctggagtgggtggcagttatatcatatgatggaggaaataaatactatgcagagtccgtgaagggccggttcaccatctccagagacaattccaagaacaccctgaatctgctaatggacagcctgagagctgaggacacggctctgttttactgtgcgagaggatacgatgttttgactggttaccccgactactggggccagggaaccctggtcaccgtctcctca

SEQ ID NO: 505 - DNA, 360 bp, Artificial Sequence
  source: /note="Description of Artificial Sequence: Synthetic polynucleotide"
caagttcagttggtgcaatctggagccgaagtaaagaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacagcctatatggaactgtctagcctgagatccgaggacaccgctgtgtattattgcgctagggggtacgatgtattgacgggttatcctgattactgggggcaggggacactcgtaaccgtctctagt

SEQ ID NO: 506 - DNA, 360 bp, Artificial Sequence
  source: /note="Description of Artificial Sequence: Synthetic polynucleotide"
caagttcagttggtgcaatctggagccgaagtaaagaagccaggagcttcagtgaaagtctcttgtgccgcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacaactcaaaaaatacagcctatatggaactgtctagcctgagatccgaggacaccgctgtgtattattgcgctagggggtacgatgtattgacgggttatcctgattactgggggcaggggacactcgtaaccgtctctagt

SEQ ID NO: 507 - DNA, 362 bp, Artificial Sequence
  source: /note="Description of Artificial Sequence: Synthetic polynucleotide"
gaggtgcagctgctggagtctgggggaggcctggtccagcctggggggtccctgcgactctcctgtgcagcctctggattcaccttcagtagatttgccatgcactgggtccgccaggctccaggcaaggggctggagtgggtggcagttatatcatatgatggaggaaataaatactatgcagagtccgtgaagggccggttcaccatctccagagacaattccaagaacaccctgtatctgcaaatgaacagcctgagagctgaggacacggctgtgtattactgtgcgagaggatacgatgttttgactggttaccccgactactggggccagggaaccctggtcaccgtctcctcagc

SEQ ID NO: 508 - DNA, 360 bp, Artificial Sequence
  source: /note="Description of Artificial Sequence: Synthetic polynucleotide"
caggtgcagctggtggagtctgggggaggcgtggtccagcctgggaggtccctgcgactctcctgtgcagcctctggattcaccttcagtcgctatgccatgcactgggtccgccaggcttcaggcaaggggctggagtgggtggcagttatatcatatgatggaagtaataaatactatgcagactccgtgaagggccgattcaccatctccagagacaattccaagaacaccctgtatctgctaatgagcagcctgagagctgaggacacggctgtgttttactgtgcgagaggatacgatattttgactggttaccccgactactggggccagggaaccctggtcaccgtctcctca

SEQ ID NO: 509 - DNA, 370 bp, Artificial Sequence
  source: /note="Description of Artificial Sequence: Synthetic polynucleotide"
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcaacgcttacaatggtcacacaaactatgcacagacgttccagggcagagtcaccatgaccacagacacatccacgagcacagcctacatggagctgaggagcctgagatctgacgacacggccgtgtattactgtgcgagggaactggaactacgctccttctattacttcggtatggacgtctggggccaagggaccacggtccccgtctctagtg

SEQ ID NO: 510 - DNA, 363 bp, Artificial Sequence
  source: /note="Description of Artificial Sequence: Synthetic polynucleotide"
caggttcagctggtgcagtctggagctgaggtgaagaagtctggggcctctttgaaggtctcctgcaaggcttctggttacatttttacccgctatggtgtcagctgggtgcgacaggcccctggacaagggcttgagtggatgggatggatcaccacttacaatggtaacacaaactatgcacagaagctccagggcagagtcaccatgaccatagacacatccacgagcacagcctacatggaactgagaagcctcagatctgacgacacggccgtgtattactgtgcgagaagagtgcggtatagtgggggctactcgtttgacaactggggccagggaaccctggtcaccgtctctagt

SEQ ID NO: 511 - DNA, 365 bp, Artificial Sequence
  source: /note="Description of Artificial Sequence: Synthetic polynucleotide"
caggttcagctggtgcagtctggagctgaggtgaagaagtctggggcctctttgaaggtctcctgcaaggcttctggttacatttttacccgctatggtgtcagctgggtgcgacaggcccctggacaagggcttgagtggatgggatggatcaccacttacaatggtaatacaaactatgcacagaagctccagggcagagtcaccatgaccacagacacatccacgagcacagcctacatggaactgaggagcctcagatctgacgacacggccgtgtattactgtgcgagaagagtgcggtacagtgggggctactcgtttgacaactggggccagggaaccctggtcaccgtctctagtgc

SEQ ID NO: 512 - DNA, 355 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctggtggctccatcagtagttactactggagctggatccggcagcccgccgggaagggactggaatggattgggcgtatctataccagtgggagcaccaactacaacccctccctcaagagtcgagtcaccatgtcaataggcacgtccaagaaccagttctccctgaagctgagctctgtgaccgccgcggacacggccgtgtattactgtgcgattattgcatctcgtggctggtacttcgatctctggggccgtggcaccctggtcaccgtctctagtg

SEQ ID NO: 513 - DNA, 359 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggaacacctactacaacccgtccctcaagagtcgagttaccatatcaggagacacgtctaagaaccagttctccctgaagctgaggtctgtgactgccgcggacacggccgtgtattactgtgcgagaggaggagcagctcgcggtatggacgtctggggccaagggaccacggtcaccgtctctagtgc

SEQ ID NO: 514 - DNA, 370 bp, Artificial Sequence
  source: /note="Description of Artificial Sequence: Synthetic polynucleotide"
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaggtggtataatgattatgcagtatctgtgaaaagtcgaataaccatcaacccagacacatccaagaaccagttctccctgcagctgaactctgtgactcccgaggacacggctgtgtattactgtgcaagaggggtcttttatagcaaaggtgcttttgatatctggggccaagggacaatggtcaccgtctctagtg

SEQ ID NO: 515 - DNA, 359 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagccgtggtggttactactggagctggatccgccagcacccagggaagggcctggagtggattgggtacatatattacagtgggaatacctactacaacccgtccctcaagagtcgagttatcatatcaggagacacgtctaagaaccagctctccctgaagctgaggtctgtgactgccgcggacacggccgtgtattattgtgcgagaggaggagcagctcgcggtatggacgtctggggccaagggaccacggtcaccgtctctagtgc

SEQ ID NO: 516 - DNA, 359 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggtttctactggagctggatccgccagcacccagggaagggcctggagtggattgggtacatctattacagtgggaatacctactacaacccgtccctcaagagtcgagttatcatatcaggagacacgtctaagaaccagttctccctgaagctgagctctgtgacggccgcggacacggccgtgtattactgtgcgagaggaggagcagctcgcggtatggacgtctggggccaagggaccacggtcaccgtctctagtgc

SEQ ID NO: 517 - DNA, 333 bp, Artificial Sequence
  source: /note="Description of Artificial Sequence: Synthetic polynucleotide"
cagtctgtgctgactcagccaccctcagcgtctgggacccccgggcagagagtcaccatctcttgttctggaagcagctccaacatcggcagtaattatgtatactggtaccagcagctcccaggagcggcccccaaactcctcatctttaggaataatcagcggccctcaggggtccctgaccgcttctctggctccaagtctggcacctcagcctccctggccatcagtgggctccggtccgaggatgaggctgattattactgtgcagcatgggatgacagcctgagtggttgggtgttcggcggagggaccaagctgaccgtcctaggt

SEQ ID NO: 518 - DNA, 333 bp, Artificial Sequence
  source: /note="Description of Artificial Sequence: Synthetic polynucleotide"
cagtctgtgctgactcagccaccctcagcgtctgggacccccgggcagagagtcaccatctcttgttctggaagcagctccaacatcggcagtaattatgtatactggtaccagcagctcccaggagcggcccccaaactcctcatctttaggaataatcagcggccctcaggggtccctgaccgcttctctggctccaagtctggcacctcagcctccctggccatcagtgggctccggtccgaggatgaggctgattattactgtgcagcatgggatgacagcctgagtggttgggtgttcggcaaggggaccaagctgaccgtcctaggt

SEQ ID NO: 519 - DNA, 333 bp, Artificial Sequence
  source: /note="Description of Artificial Sequence: Synthetic polynucleotide"
cagtctgtgctgactcagtcaccctcagcgtctgggacccccgggcagagagtcaccatctcttgttctggaagcagctccaacatcggcagtaattatgtatactggtaccagcagctcccaggagcggcccccaaactcctcatccttaggaataatcagcggccctcaggggtccctgaccgattctctggctccaagtctggcacctcagcctccctgaccatcagtgggctccggtccgaggatgaggctgactattattgtgcagcatgggatgacagcctgagtggttgggtgttcggcggagggaccaagctgaccgtcctaggt

SEQ ID NO: 520 - DNA, 333 bp, Artificial Sequence
  source: /note="Description of Artificial Sequence: Synthetic polynucleotide"
cagtctgtgctgactcagtcaccctcagcgtctgggacccccgggcagagagtcaccatctcttgttctggaagcagctccaacatcggcagtaattatgtatactggtaccagcagctcccaggagcggcccccaaactcctcatccttaggaataatcagcggccctcaggggtccctgaccgattctctggctccaagtctggcacctcagcctccctgaccatcagtgggctccggtccgaggatgaggctgactattattgtgcagcatgggatgacagcctgagtggttgggtgttcggcaaggggaccaagctgaccgtcctaggt

SEQ ID NO: 521 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggt

SEQ ID NO: 522 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcaaggggaccaagctgaccgtcctaggt

SEQ ID NO: 523 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggt

SEQ ID NO: 524 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcaaggggaccaagctgaccgtcctaggt

SEQ ID NO: 525 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcggagggaccaagctgaccgtcctaggt

SEQ ID NO: 526 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcaaggggaccaagctgaccgtcctaggt

SEQ ID NO: 527 - DNA, 327 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcggctacttaacctggtaccagcagaaacctggccaggctcccagactcctcatctatggtgcatccagcagggccactggcatcccagacaggttcagtggcagtgggtctgggacggacttcactctcaccatcagcagactggagcctgaagattttgcagtgtattactgtcagcagtatggtaactcactgagcaggtttggccaggggaccaagctggaaatcaaacgt

SEQ ID NO: 528 - DNA, 327 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcggctacttaacctggtaccagcagaaacctggccaggctcccagactcctcatctatggtgcatccagcagggccactggcatcccagacaggttcagtggcagtgggtctggtacggacttcactctcaccatcagcagactggagcctgaagattttgcagtgtattactgtcagcagtatggtaactcactgagcaggtttggcaaggggaccaagctggagatcaaacgt

SEQ ID NO: 529 - DNA, 330 bp, Artificial Sequence
  source: /note="Description of Artificial Sequence: Synthetic polynucleotide"
cagtctgtgttgacgcagccgccctcagtgtctgaggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtccta

SEQ ID NO: 530 - DNA, 330 bp, Artificial Sequence
  source: /note="Description of Artificial Sequence: Synthetic polynucleotide"
cagtctgtgctgactcagccaccctcagcgtctgggacccccgggcagagagtcaccatctcttgttctggaagcagctccaacatcggcagtaattatgtatactggtaccagcagctcccaggagcggcccccaaactcctcatctttaggagtaatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggagggaccaagctgaccgtccta

SEQ ID NO: 531 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagatttagcaacttattactgtctacagtataatatttacccgtggacgttcggccaagggaccaaggtggaaatcaaa

SEQ ID NO: 532 - DNA, 324 bp, Artificial Sequence
  source: /note="Description of Artificial Sequence: Synthetic polynucleotide"
tcttctgagctgactcaggaccctactgtgtctgtggccttgggacagacagtcaaaatcacatgccaaggagacagcctcagaagtttttatgcaagctggtaccagcagaagccaggacaggcccctgtacttgtcttctatggtaaaaacaaccggccctcagggatcccagaccgattctctggctccagctcaggaaacacagcttccttgaccatcactggggctcaggcggaagatgaggctgactattattgtaattcccgggacagcagtgtttaccatctggtactcggcggagggaccaagctgaccgtccta

SEQ ID NO: 533 - DNA, 336 bp, Artificial Sequence
  source: /note="Description of Artificial Sequence: Synthetic polynucleotide"
gatattatactggcccagactccactttctctgtccgtcacccctggacagccggcctccatctcctgcaagtctagtcagagcctcctgcacagtgctggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttgggatttattactgcatgcaaagttttccgcttccgctcactttcggcggagggaccaaggtggagatcaaa

SEQ ID NO: 534 - DNA, 336 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagttttgggtacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 535 - DNA, 336 bp, Artificial Sequence
  source: /note="Description of Artificial Sequence: Synthetic polynucleotide"
gatattattctgacccagactccactttctctgtccgtcacccctggacagccggcctccatctcctgcaagtctagtcagagcctcctgcacagtgatggaaagacctatttgtattggtacctgcagaagcccggccagcctccacagctcctgatctatgaagtttccaaccggttctctggagagccagataggttcagtggcagcgggtcagggacagatttcacactgaaaatcagccgggtggaggctgaggatgttgggacttattattgcatgcaaagttttccgcttccgctcactttcggcggagggaccaaggtggagatcaaa

SEQ ID NO: 536 - DNA, 330 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtccta

SEQ ID NO: 537 - DNA, 330 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagcagttccaatatcggaagtaatactgtgaactggtaccagcagctcccaggaacggcccccaaactcctcatctatactaataatcagcggccctcaggggtccctgaccgattctctggctccaagtctggcacctcagcctccctggccatcagtggactccagtctgaggatgaggctgatttttactgtgcagcgcgggatgagagcctgaatggtgtggtattcggcggagggaccaagctgaccgtccta

SEQ ID NO: 538 - DNA, 336 bp, Artificial Sequence
  source: /note="Description of Artificial Sequence: Synthetic polynucleotide"
gatattacactgacccagactccactttctctgtccgtctcccctggacagccggcctccatctcctgcaagtctagtcagagcctcctgcacagtgatggaaggaactatctgtattggtacctgcagaagccaggccagcctccacagctcctgatctatgaagtgtccaaccggttctctggactgccagataggttcagtggcagcgggtcagggacagatttcacactgaaaatcagccgggtggaggctgaggatgttgggatttattactgcatgcaaagttttccgcttccgctcactttcggcggagggaccaaggtggagatcaaa

SEQ ID NO: 539 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagggcattagaaaggatttaggctggtatcagcagaaaccagggaaagcccctaagcgcctgatctatggagcatccagtttgcaaagtggggtcccatcaaggttcagcggcagtggatctgggacagaattcactctcacaatcagcagcctgcagcctgaagattttgcaacttattactgtctacagtataatagtttcccgtggacgttcggccaagggaccaaggtggaaatcaaa

SEQ ID NO: 540 - DNA, 393 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagt

SEQ ID NO: 541 - DNA, 393 bp, Artificial Sequence
  source: /note="Description of Artificial Sequence: Synthetic polynucleotide"
gaggtacagctggtggagtctgggggaggcttggtaaagcctggggggtccctcagactctcctgtgcagcctctggattcactttcggtaacgcctggatgagctgggtccgccaggctccagggaaggagctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtatttctgtaccacagatcggaccgggtatagcatcagctggtctagttactactactactacggtatggacgtctggggccaaggaacaacagttaccgtctctagt

SEQ ID NO: 542 - DNA, 393 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaaggaacaacagttaccgtctctagt

SEQ ID NO: 543 - DNA, 393 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggagctggagtgggttggccgtattaaaagcaaaactgatggtgggacaacagactacactgcacccgtgaaaggcagattcaccatctcaagagatgattcaaaaaacacgctgtatctgcaaatgaatagcctgaaagccgaggacacagccgtgtattactgtaccacagatcggaccgggtatagcatcagctggtctagttactactactactacggtatggacgtctggggccaaggaacaacagttaccgtctctagt

SEQ ID NO: 544 - DNA, 390 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagt

SEQ ID NO: 545 - DNA, 390 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccagggaaggagctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagt

SEQ ID NO: 546 - DNA, 390 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 547 - DNA, 390 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccagggaaggagctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgagagtagtggttattatcactacaaatactacggtatggccgtctggggccaagggacaacagttaccgtctctagt

SEQ ID NO: 548 - DNA, 378 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagt

SEQ ID NO: 549 - DNA, 378 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccagggaaggagctggagtgggtggcagttatatggtatgatggaagtaataaatactatgcagactccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagt

SEQ ID NO: 550 - DNA, 378 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagagtccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagt

SEQ ID NO: 551 - DNA, 378 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccagggaaggagctggagtgggtggcagttatatggtatgatggaagtaataaatactatgcagagtccgtgaagggccgattcatcatctccagagataaatccaagaacacgctgtatctgcaaatgaacagcctgagagccgaggacacggctgtgtattactgtgcgagagcggggggtatagcagcagctggcctctactactactacggtatggacgtctggggccaagggacaacagttaccgtctctagt

SEQ ID NO: 552 - DNA, 393 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcacaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcggaccggatatagcatcagctggtctagttactactactactacggtatggacgtctggggccaagggaccacggtcaccgtctctagt

SEQ ID NO: 553 - DNA, 390 bp, Artificial Sequence
  source: /note="Description of Artificial Sequence: Synthetic polynucleotide"
gaggtgcagctattggagtctgggggaggcttggtacagcctggggagtccctgagactctcctgtgcagcctctgggttcacctttagcagctatgccatgagctgggtccgccaggctccagggaaggggctggagtgggtctcagctattagtggtagtggtggtcgcacatactacgcagactccgtgaagggccggttcaccatctccagagacaattccaagaacacgctgtatctgcaaatgaatagcctgagagccgaggacacggccgtatattactgtgcgaaagatcaaagggaggtagggccgtatagcagtggctggtacgactactactacggtatggacgtctggggccaagggaccacggtcaccgtctctagt

SEQ ID NO: 554 - DNA, 390 bp, Artificial Sequence
  source: /note="Description of Artificial Sequence: Synthetic polynucleotide"
caggtgcagttggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtatttctgtgcgagagatcaaatgagtattattatgcttcggggagtttttcccccttactattacggtatggacgtctggggccaagggaccacggtcaccgtctctagt

SEQ ID NO: 555 - DNA, 387 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatttcatatgatggaagtcatgaatcctatgcagactccgtgaagggccgattcaccatctccagagacatttccaagaacacgctgtatctgcaaatgaacagcctgagagctgaggacacggctgtgtatttctgtgcgagagagaggaaacgggttacgatgtctaccttatattactacttctactacggtatggacgtctggggccaagggaccacggtcaccgtctctagt

SEQ ID NO: 556 - DNA, 363 bp, Artificial Sequence
  source: /note="Description of Artificial Sequence: Synthetic polynucleotide"
gaggtgcagctggtggagtctgggggaggcttggtaaagccagggcggtccctgagactctcctgtacagcttctggattcacctttggtgattatgctatgagctggttccgccaggctccagggaaggggctggagtggataggtttcattagaagcagagcttatggtgggacaccagaatacgccgcgtctgtgaaaggcagattcaccatctcaagagatgattccaaaaccatcgcctatctgcaaatgaacagcctgaaaaccgaggacacagccgtgtatttctgtgctagaggacggggtattgcagctcgttgggactactggggccagggaaccctggtcaccgtctctagt

SEQ ID NO: 557 - DNA, 381 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccgactactatatgtactgggtgcgacaggcccctggacaagggcttgagtggatgggatggatcagccctaatagtggtggcacaaactatgcccagaagtttcagggcagggtcaccatgaccagggacacgtctatcagcacagcctacatggagctgagtaggctgagatctgacgacacggccgtgtattactgtgtgagaggaggatatagtggctacgctgggctctactcccactactacggtatggacgtctggggccaagggaccacggtcaccgtctctagt

SEQ ID NO: 558 - DNA, 393 bp, Artificial Sequence
  source: /note="Description of Artificial Sequence: Synthetic polynucleotide"
gaggtgcagctggtggagtctgggggaggcctggtcaagcctggggggtccctgagactctcctgtgcagcctctggatacaccttcagtacctatagcatgaactgggtccgccaggctccagggaaggggctggagtgggtctcatccattagtagtagtagtagttacagatattacgcagactcagtgaagggccgattcaccatctccagagacaacgccaagaactcactgtatctgcaaatgagtagcctgagagccgaggacacggctgtgtattactgtgcgagagaaggggtgtctggcagttcgccgtatagcatcagctggtacgactactattacggtatggacgtctggggccaagggaccacggtcaccgtctctagt

SEQ ID NO: 559 - DNA, 393 bp, Artificial Sequence
  source: /note="Description of Artificial Sequence: Synthetic polynucleotide"
gaggtacagctggtggagtctgggggaggcttggtaaagcctggggggtcccttagactctcctgtgcagcctctggattcactttcggtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcggaccgggtatagcatcagctggtctagttactactactactacggtatggacgtctggggccaagggaccacggtcaccgtctctagt

SEQ ID NO: 560 - DNA, 390 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcattgggtccgccaggctccaggcaaggggctggagtgggtggcagttatatcatttgatggaagtattaagtactctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtctggccgtctggggccaagggaccacggtcaccgtctctagt

SEQ ID NO: 561 - DNA, 642 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagcttgagcggtgtgccgtcgcgcttctccggttccggaagcggaacggaattcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 562 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 563 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 564 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 565 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaagtgtctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggctgtgggaccaagctgaccgtgcta

SEQ ID NO: 566 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtgcttggaggcggaggatctggtggcggtggttctggcggcggaggctcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagt

SEQ ID NO: 567 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcggagggaccaagctgaccgtgcttggaggcggaggatctggtggcggtggttctggcggcggaggctcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagt

SEQ ID NO: 568 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtgcttggaggcggaggatctggtggcggtggttctggcggcggaggctcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagt

SEQ ID NO: 569 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtgcttggaggcggaggatctggtggcggtggttctggcggcggaggctcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagt

SEQ ID NO: 570 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtgcttggaggcggaggatctggtggcggtggttctggcggcggaggctcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagt

SEQ ID NO: 571 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtgcta

SEQ ID NO: 572 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtgcta

SEQ ID NO: 573 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaagtgtctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggctgtgggaccaagctgaccgtgcta

SEQ ID NO: 574 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggcggagggaccaagctgaccgtgcta

SEQ ID NO: 575 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggcggagggaccaagctgaccgtgcta

SEQ ID NO: 576 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaagtgtctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagccgcctgagtgctgtggttttcggctgtgggaccaagctgaccgtgcta

SEQ ID NO: 577 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaagtgtctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagccgcctgagtgctgtggttttcggctgtgggaccaagctgaccgtgcta

SEQ ID NO: 578 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaagtgtctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggctgtgggaccaagctgaccgtgcta

SEQ ID NO: 579 - DNA, 2139 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttactgtctctagtggaggcggaggatctggtggcggtggttctggcggcggaggctcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtgcta

SEQ ID NO: 580 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtggaggcggaggatctggtggcggtggttctggcggcggaggctcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtgtcttca

SEQ ID NO: 581 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtggaggcggaggatctggtggcggtggttctggcggcggaggctcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtgtcttca

SEQ ID NO: 582 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctcctcaggaggcggaggatctggtggcggtggttctggcggcggaggctccgatatccagctcactcaatcgccatcatttctctccgcttcggtaggcgaccgggtcacgatcacatgcagggcgtcgcaaagcattgggaggtcgttgcattggtatcagcagaaacccggaaagtgcccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggctgtgggaccaaggtggacattaagcgt

SEQ ID NO: 583 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctcctcaggaggcggaggatctggtggcggtggttctggcggcggaggctccgatatccagctcactcaatcgccatcatttctctccgcttcggtaggcgaccgggtcacgatcacatgcagggcgtcgcaaagcattgggaggtcgttgcattggtatcagcagaaacccggaaagtgcccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggctgtgggaccaaggtggacattaagcgt

SEQ ID NO: 584 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctcctcaggaggcggaggatctggtggcggtggttctggcggcggaggctccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgt

SEQ ID NO: 585 - DNA, 2133 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccaagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctcctcaggaggcggaggatctggtggcggtggttctggcggcggaggctccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgt

SEQ ID NO: 586 - DNA, 2133 bp, Artificial Sequence; identical to SEQ ID NO: 582
  source: /note="Description of Artificial Sequence: Synthetic polynucleotide"

SEQ ID NO: 587 - DNA, 2133 bp, Artificial Sequence; identical to SEQ ID NO: 583
  source: /note="Description of Artificial Sequence: Synthetic polynucleotide"

SEQ ID NO: 588 - DNA, 2133 bp, Artificial Sequence; identical to SEQ ID NO: 584
  source: /note="Description of Artificial Sequence: Synthetic polynucleotide"

SEQ ID NO: 589 - DNA, 2133 bp, Artificial Sequence; identical to SEQ ID NO: 585
  source: /note="Description of Artificial Sequence: Synthetic polynucleotide"

SEQ ID NO: 590 - DNA, 2133 bp, Artificial Sequence; identical to SEQ ID NO: 581
  source: /note="Description of Artificial Sequence: Synthetic polynucleotide"

SEQ ID NO: 591 - DNA, 2133 bp, Artificial Sequence; identical to SEQ ID NO: 583
  source: /note="Description of Artificial Sequence: Synthetic polynucleotide"

SEQ ID NO: 592 - DNA, 2133 bp, Artificial Sequence; identical to SEQ ID NO: 585
  source: /note="Description of Artificial Sequence: Synthetic polynucleotide"

SEQ ID NO: 593 - DNA, 2133 bp, Artificial Sequence; identical to SEQ ID NO: 580
  source: /note="Description of Artificial Sequence: Synthetic polynucleotide"

SEQ ID NO: 594 - DNA, 2133 bp, Artificial Sequence; identical to SEQ ID NO: 581
  source: /note="Description of Artificial Sequence: Synthetic polynucleotide"

SEQ ID NO: 595 - DNA, 642 bp, Artificial Sequence
  source: /note="Description of Artificial Sequence: Synthetic polynucleotide"
gatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 596 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattgggaataattatgtatcctggtaccagaagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 597 - DNA, 1998 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctagctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactgaagagtgtcgtcaccgttccctcttccagcctcggcactcaaacttacatctgcaacgtgaatcataagccatctaacaccaaggtagacaagaaagtc

SEQ ID NO: 598 - DNA, 1998 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagaagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctagctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactgaagagtgtcgtcaccgttccctcttccagcctcggcactcaaacttacatctgcaacgtgaatcataagccatctaacaccaaggtagacaagaaagtc

SEQ ID NO: 599 - DNA, 1998 bp, Artificial Sequence; identical to SEQ ID NO: 597
  source: /note="Description of Artificial Sequence: Synthetic polynucleotide"

SEQ ID NO: 600 - DNA, 1998 bp, Artificial Sequence; identical to SEQ ID NO: 598
  source: /note="Description of Artificial Sequence: Synthetic polynucleotide"

SEQ ID NO: 601 - DNA, 2022 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 602 - DNA, 2022 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagaagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 603 - DNA, 2022 bp, Artificial Sequence; identical to SEQ ID NO: 602
  source: /note="Description of Artificial Sequence: Synthetic polynucleotide"

SEQ ID NO: 604 - DNA, 2022 bp, Artificial Sequence; identical to SEQ ID NO: 601
  source: /note="Description of Artificial Sequence: Synthetic polynucleotide"

SEQ ID NO: 605 - DNA, 2022 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggaaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 606 - DNA, 2022 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggaaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatcccagtctgtgttgacgcagccgccctcagtgtctgcggccccaggacagaaggtcaccatctcctgctctggaagcagctccaacattgggaataattatgtatcctggtaccagaagctcccaggaacagcccccaaactcctcatttatgacaataataagcgaccctcagggattcctgaccgattctctggctccaagtctggcacgtcaaccaccctgggcatcaccggactccagactggggacgaggccgattattactgcggaacatgggatagccgcctgagtgctgtggttttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttca

SEQ ID NO: 607 - DNA, 2022 bp, Artificial Sequence; identical to SEQ ID NO: 605
  source: /note="Description of Artificial Sequence: Synthetic polynucleotide"

SEQ ID NO: 608 - DNA, 2022 bp, Artificial Sequence; identical to SEQ ID NO: 606
  source: /note="Description of Artificial Sequence: Synthetic polynucleotide"

SEQ ID NO: 609 - DNA, 2022 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtgctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactggagagtgtcgtcaccgttccctcttccagcctcggcactcaaacttacatctgcaacgtgaatcataagccatctaacaccaaggtagacaagaaagtc

SEQ ID NO: 610 - DNA, 2022 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtgctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactggagagtgtcgtcaccgttccctcttccagcctcggcactcaaacttacatctgcaacgtgaatcataagccatctaacaccaaggtagacaagaaagtc

SEQ ID NO: 611 - DNA, 2022 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtgctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactggagagtgtcgtcaccgttccctcttccagcctcggcactcaaacttacatctgcaacgtgaatcataagccatctaacaccaaggtagacaagaaagtc

SEQ ID NO: 612 - DNA, 2022 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtgctagtacaaagggcccctccgtctttccactcgcacccagttcaaagtccacttctggaggcactgcggccttgggctgtttggtgaaagactacttcccagagccagtgacagtctcttggaatagcggagcactgaccagcggtgtgcatacctttccagctgtgctgcagagcagcggcctctactcactggagagtgtcgtcaccgttccctcttccagcctcggcactcaaacttacatctgcaacgtgaatcataagccatctaacaccaaggtagacaagaaagtc

SEQ ID NO: 613 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 614 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 615 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 616 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 617 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 618 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 619 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcagcagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 620 - DNA, 2046 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaagggacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctaagcttgtctccgggtggtggcggatcgggaggtggcggatccgatatccagctcactcaatcgccatcatttctctccgcttcggtaggcgaccgggtcacgatcacatgcagggcgtcgcaaagcattgggaggtcgttgcattggtatcaggagaaacccggaaaggccccgaaacttctgatcaaatacgcatcacaaagtttgagcggtgtgccgtcgcgcttctccggttccggaagcggaacggagttcacgcttacaatctcctcactgcagcccgaggatttcgcgacctattactgtcaccagtcatccagactcccgtttacttttggccctgggaccaaggtggacattaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 621 - DNA, 708 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaaggaacaacagttaccgtctctagtggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgaaagctacctgagcctgacgcccgagcagtggaagtcccacagaagctacagctgccaggtcacgcatgaagggagcaccgtggagaagacagtggcccctacagaatgttca

SEQ ID NO: 622 - DNA, 708 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaaggaacaacagttaccgtctctagtggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgaaagctacctgagcctgacgcccgagcagtggaagtcccacagaagctacagctgccaggtcacgcatgaagggagcaccgtggagaagacagtggcccctacagaatgttca

SEQ ID NO: 623 - DNA, 708 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaaggaacaacagttaccgtctctagtggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgaaagctacctgagcctgacgcccgagcagtggaagtcccacagaagctacagctgccaggtcacgcatgaagggagcaccgtggagaagacagtggcccctacagaatgttca

SEQ ID NO: 624 - DNA, 708 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaaggaacaacagttaccgtctctagtggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgaaagctacctgagcctgacgcccgagcagtggaagtcccacagaagctacagctgccaggtcacgcatgaagggagcaccgtggagaagacagtggcccctacagaatgttca

SEQ ID NO: 625 - DNA, 684 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagtt

SEQ ID NO: 626 - DNA, 684 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgatagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagtt

SEQ ID NO: 627 - DNA, 684 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgcgaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagtt

SEQ ID NO: 628 - DNA, 684 bp, Artificial Sequence
  source: /note="Description of Artificial Sequence: Synthetic polynucleotide"
caggtgcagctggtggaatctgggggaggcgtggtccagcctgggaggtccctgagactctcctgtgcagcctctggattcaccttcagtagctttggcatgcactgggtccgccaggctccaggcaaggggctggagtgggtggcagttatatcatttgatggaagtattaagtattctgtagactccgtgaagggccgattcaccatctccagagacaattcaaagaacacgctgtttctgcaaatgaacagcctgcgagccgaggacacggctgtgtattactgtgcgagagatcggctcaattactatgaaagtagtggttattatcactacaaatactacggtatggccgtctggggccaaggaacaacagttaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagtt

SEQ ID NO: 629 - DNA, 678 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 630 - DNA, 678 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggaaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 631 - DNA, 654 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggcaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagtt

SEQ ID NO: 632 - DNA, 654 bp, Artificial Sequence
  source: /note="Description of Artificial Sequence: Synthetic polynucleotide"
caagttcagttggtggagtctggagccgaagtagtaaagccaggagcttcagtgaaagtctcttgtaaagcaagtggattcacgtttagccgctttgccatgcattgggtgcggaaagctcccggtcaggggttggagtggatgggagttattagctatgacgggggcaataagtactacgccgagtctgttaagggtcgggtcacaatgacacgggacacctcaaccagtacactctatatggaactgtctagcctgagatccgaggacaccgctgtgtattattgcgctagggggtacgatgtattgacgggttatcctgattactgggggcaggggacactcgtaaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagtt

SEQ ID NO: 633 - protein, 22 aa, Artificial Sequence
  source: /note="Description of Artificial Sequence: Synthetic peptide"
MDMRVPAQLLGLLLLWLRGARC

SEQ ID NO: 634 - protein, 19 aa, Artificial Sequence
  source: /note="Description of Artificial Sequence: Synthetic peptide"
MAWALLLLTLLTQGTGSWA

SEQ ID NO: 635 - protein, 19 aa, Artificial Sequence
  source: /note="Description of Artificial Sequence: Synthetic peptide"
MTCSPLLLTLLIHCTGSWA

SEQ ID NO: 636 - protein, 20 aa, Artificial Sequence
  source: /note="Description of Artificial Sequence: Synthetic peptide"
MEAPAQLLFLLLLWLPDTTG

SEQ ID NO: 637 - protein, 19 aa, Artificial Sequence
  source: /note="Description of Artificial Sequence: Synthetic peptide"
MEWTWRVLFLVAAATGAHS

SEQ ID NO: 638 - protein, 20 aa, Artificial Sequence
  source: /note="Description of Artificial Sequence: Synthetic peptide"
METPAQLLFLLLLWLPDTTG

SEQ ID NO: 639 - protein, 20 aa, Artificial Sequence
  source: /note="Description of Artificial Sequence: Synthetic peptide"
METPAQLLFLLLLWLPDTTG

SEQ ID NO: 640 - protein, 19 aa, Artificial Sequence
  source: /note="Description of Artificial Sequence: Synthetic peptide"
MKHLWFFLLLVAAPRWVLS

SEQ ID NO: 641 - protein, 19 aa, Artificial Sequence
  source: /note="Description of Artificial Sequence: Synthetic peptide"
MEWSWVFLFFLSVTTGVHS

SEQ ID NO: 642 - protein, 8 aa, Artificial Sequence
  source: /note="Description of Artificial Sequence: Synthetic peptide"
  VARIANT (3)..(8): /replace=" "
  misc_feature (1)..(8): /note="Variant residues given in the sequence have no preference with respect to those in the annotations for variant positions"
GGGGGGGG

SEQ ID NO: 643 - protein, 8 aa, Artificial Sequence
  source: /note="Description of Artificial Sequence: Synthetic peptide"
  VARIANT (3)..(8): /replace=" "
  misc_feature (1)..(8): /note="This sequence may encompass 2-4 "Gly-Ala" repeating units, wherein some positions may be absent"
  misc_feature (1)..(8): /note="Variant residues given in the sequence have no preference with respect to those in the annotations for variant positions"
GAGAGAGA

SEQ ID NO: 644 - protein, 8 aa, Artificial Sequence
  source: /note="Description of Artificial Sequence: Synthetic peptide"
  VARIANT (3)..(8): /replace=" "
  misc_feature (1)..(8): /note="Variant residues given in the sequence have no preference with respect to those in the annotations for variant positions"
AAAAAAAA

SEQ ID NO: 645 - protein, 30 aa, Artificial Sequence
  source: /note="Description of Artificial Sequence: Synthetic polypeptide"
  VARIANT (4)..(4): /replace=" "
  VARIANT (9)..(9): /replace=" "
  VARIANT (14)..(14): /replace=" "
  VARIANT (19)..(19): /replace=" "
  VARIANT (24)..(24): /replace=" "
  VARIANT (29)..(29): /replace=" "
  misc_feature (1)..(30): /note="This sequence may encompass 2-6 "GlyxSer" repeating units, wherein X is 3-4 and some positions may be absent"
  misc_feature (1)..(30): /note="Variant residues given in the sequence have no preference with respect to those in the annotations for variant positions"
GGGGSGGGGSGGGGSGGGGSGGGGSGGGGS

SEQ ID NO: 646 - protein, 6 aa, Artificial Sequence
  source: /note="Description of Artificial Sequence: Synthetic 6xHis tag"
HHHHHH

What is claimed:

1. A bispecific antigen binding protein comprising a first binding domain that specifically binds to human CGRP receptor and a second binding domain that specifically binds to human PAC1 receptor at an epitope within the amino-terminal extracellular domain defined by amino acids 21 to 155 of SEQ ID NO: 339, wherein the first binding domain comprises a first light chain immunoglobulin variable region (VL1) and a first heavy chain immunoglobulin variable region (VH1), and the second binding domain comprises a second light chain immunoglobulin variable region (VL2) and a second heavy chain immunoglobulin variable region (VH2), and wherein VL2 comprises (i) a CDRL1 selected from SEQ ID NOs: 1 to 13, (ii) a CDRL2 selected from SEQ ID NOs: 14 to 19, and (iii) a CDRL3 selected from SEQ ID NOs: 20 to 27, and wherein VH2 comprises (i) a CDRH1 selected from SEQ ID NOs: 55 to 65, (ii) a CDRH2 selected from SEQ ID NOs: 66 to 73, and (iii) a CDRH3 selected from SEQ ID NOs: 74 to 82.

2. The bispecific antigen binding protein of claim 1, wherein VL1 comprises (i) a CDRL1 selected from SEQ ID NOs: 109 to 119, (ii) a CDRL2 selected from SEQ ID NOs: 14, 17, 18, and 120 to 126, and (iii) a CDRL3 selected from SEQ ID NOs: 127 to 135, and wherein VH1 comprises (i) a CDRH1 selected from SEQ ID NOs: 159 to 166, (ii) a CDRH2 selected from SEQ ID NOs: 167 to 178, and (iii) a CDRH3 selected from SEQ ID NOs: 179 to 189.

3. The bispecific antigen binding protein of claim 2, wherein VL1 comprises a sequence that is at least 90% identical to an amino acid sequence selected from SEQ ID NOs: 136 to 158, and wherein VH1 comprises a sequence that is at least 90% identical to an amino acid sequence selected from SEQ ID NOs: 190 to 210.

4. The bispecific antigen binding protein of claim 1, wherein VL1 comprises a CDRL1, a CDRL2, and a CDRL3, and VH1 comprises a CDRH1, a CDRH2, and a CDRH3, and wherein:
(a) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 167 and 179, respectively;
(b) CDRL1, CDRL2, and CDRL3 have the sequence of SEQ ID NOs: 109, 120 and 127, respectively, and CDRH1, CDRH2, and CDRH3 have the sequence of SEQ ID NOs: 159, 168 and 179, respectively;
(c) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 180, respectively;
(d) CDRL1, CDRL2, and CDRL3 have the sequence of SEQ ID NOs: 110, 121 and 128, respectively, and CDRH1, CDRH2, and CDRH3 have the sequence of SEQ ID NOs: 160, 169 and 181, respectively;
(e) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 170 and 182, respectively; or
(f) CDRL1, CDRL2, and CDRL3 have the sequence of SEQ ID NOs: 111, 17 and 129, respectively, and CDRH1, CDRH2, and CDRH3 have the sequence of SEQ ID NOs: 161, 171 and 182, respectively.

5. The bispecific antigen binding protein of claim 1, wherein:
(a) VL1 comprises the sequence of SEQ ID NO: 136 and VH1 comprises the sequence of SEQ ID NO: 190;
(b) VL1 comprises the sequence of SEQ ID NO: 138 and VH1 comprises the sequence of SEQ ID NO: 192;
(c) VL1 comprises the sequence of SEQ ID NO: 140 and VH1 comprises the sequence of SEQ ID NO: 194;
(d) VL1 comprises the sequence of SEQ ID NO: 140 and VH1 comprises the sequence of SEQ ID NO: 196;
(e) VL1 comprises the sequence of SEQ ID NO: 142 and VH1 comprises the sequence of SEQ ID NO: 194;
(f) VL1 comprises the sequence of SEQ ID NO: 142 and VH1 comprises the sequence of SEQ ID NO: 196;
(g) VL1 comprises the sequence of SEQ ID NO: 144 and VH1 comprises the sequence of SEQ ID NO: 194;
(h) VL1 comprises the sequence of SEQ ID NO: 146 and VH1 comprises the sequence of SEQ ID NO: 198; or
(i) VL1 comprises the sequence of SEQ ID NO: 146 and VH1 comprises the sequence of SEQ ID NO: 200.

6. The bispecific antigen binding protein of claim 1, wherein:
(a) CDRL1, CDRL2, and CDRL3 of VL2 have the sequence of SEQ ID NOs: 1, 14 and 20, respectively, and CDRH1, CDRH2, and CDRH3 of VH2 have the sequence of SEQ ID NOs: 55, 66 and 74, respectively;
(b) CDRL1, CDRL2, and CDRL3 of VL2 have the sequence of SEQ ID NOs: 2, 15 and 21, respectively, and CDRH1, CDRH2, and CDRH3 of VH2 have the sequence of SEQ ID NOs: 56, 67 and 75, respectively;
(c) CDRL1, CDRL2, and CDRL3 of VL2 have the sequence of SEQ ID NOs: 3, 15 and 21, respectively, and CDRH1, CDRH2, and CDRH3 of VH2 have the sequence of SEQ ID NOs: 56, 67 and 75, respectively; or (d) CDRL1, CDRL2, and CDRL3 of VL2 have the sequence of SEQ ID NOs: 4, 16 and 22, respectively, and CDRH1, CDRH2, and CDRH3 of VH2 have the sequence of SEQ ID NOs: 57, 68 and 76, respectively.

7. The bispecific antigen binding protein of claim 1, wherein VL2 comprises a sequence that is at least 90% identical to an amino acid sequence selected from SEQ ID NOs: 28 to 54, and wherein VH2 comprises a sequence that is at least 90% identical to an amino acid sequence selected from SEQ ID NOs: 83 to 108.

8. The bispecific antigen binding protein of claim 1, wherein:
(a) VL2 comprises the sequence of SEQ ID NO: 28 and VH2 comprises the sequence of SEQ ID NO: 83;
(b) VL2 comprises the sequence of SEQ ID NO: 30 and VH2 comprises the sequence of SEQ ID NO: 83;
(c) VL2 comprises the sequence of SEQ ID NO: 31 and VH2 comprises the sequence of SEQ ID NO: 85;
(d) VL2 comprises the sequence of SEQ ID NO: 33 and VH2 comprises the sequence of SEQ ID NO: 87;
(e) VL2 comprises the sequence of SEQ ID NO: 35 and VH2 comprises the sequence of SEQ ID NO: 89; or
(f) VL2 comprises the sequence of SEQ ID NO: 37 and VH2 comprises the sequence of SEQ ID NO: 91.

9. The bispecific antigen binding protein of claim 1, wherein the first binding domain and/or the second binding domain comprise a Fab fragment, a Fab' fragment, a F(ab')$_2$ fragment, a Fv fragment, or a single-chain variable fragment (scFv).

10. The bispecific antigen binding protein of claim 1, wherein the binding protein comprises a constant region from an IgG1, IgG2, IgG3, or IgG4 immunoglobulin.

11. The bispecific antigen binding protein of claim 10, wherein the constant region comprises human IgG1 or IgG2 immunoglobulin CH2 and CH3 domains.

12. The bispecific antigen binding protein of claim 1, wherein the binding protein is an antibody.

13. The bispecific antigen binding protein of claim 12, wherein the antibody comprises a first light chain (LC1) and a first heavy chain (HC1) from a first antibody that specifically binds to human CGRP receptor and a second light chain (LC2) and second heavy chain (HC2) from a second antibody that specifically binds to human PAC1 receptor.

14. The bispecific antigen binding protein of claim 13, wherein LC1 comprises a sequence selected from SEQ ID NOs: 271 to 282, and wherein HC1 comprises a sequence selected from SEQ ID NOs: 295 to 316.

15. The bispecific antigen binding protein of claim 13, wherein LC2 comprises a sequence selected from SEQ ID NOs: 211 to 221, and wherein HC2 comprises a sequence selected from SEQ ID NOs: 233 to 251.

16. The bispecific antigen binding protein of claim 13, wherein:
(a) LC1 comprises the sequence of SEQ ID NO: 271 and HC1 comprises the sequence of SEQ ID NO: 295, SEQ ID NO: 297, or SEQ ID NO: 298;
(b) LC1 comprises the sequence of SEQ ID NO: 272 and HC1 comprises the sequence of SEQ ID NO: 296;
(c) LC1 comprises the sequence of SEQ ID NO: 273 and HC1 comprises the sequence of SEQ ID NO: 299, SEQ ID NO: 301, or SEQ ID NO: 302;
(d) LC1 comprises the sequence of SEQ ID NO: 274 and HC1 comprises the sequence of SEQ ID NO: 300;
(e) LC1 comprises the sequence of SEQ ID NO: 275 and HC1 comprises the sequence of SEQ ID NO: 303, SEQ ID NO: 305, SEQ ID NO: 306, SEQ ID NO: 307, or SEQ ID NO: 309;

(f) LC1 comprises the sequence of SEQ ID NO: 276 and HC1 comprises the sequence of SEQ ID NO: 304 or SEQ ID NO: 308;
(g) LC1 comprises the sequence of SEQ ID NO: 277 and HC1 comprises the sequence of SEQ ID NO: 303, SEQ ID NO: 305, SEQ ID NO: 307, or SEQ ID NO: 309;
(h) LC1 comprises the sequence of SEQ ID NO: 278 and HC1 comprises the sequence of SEQ ID NO: 304 or SEQ ID NO: 308;
(i) LC1 comprises the sequence of SEQ ID NO: 279 and HC1 comprises the sequence of SEQ ID NO: 303 or SEQ ID NO: 305;
(j) LC1 comprises the sequence of SEQ ID NO: 280 and HC1 comprises the sequence of SEQ ID NO: 304;
(k) LC1 comprises the sequence of SEQ ID NO: 281 and HC1 comprises the sequence of SEQ ID NO: 310, SEQ ID NO: 312, SEQ ID NO: 313, SEQ ID NO: 314, or SEQ ID NO: 316; or
(l) LC1 comprises the sequence of SEQ ID NO: 282 and HC1 comprises the sequence of SEQ ID NO: 311 or SEQ ID NO: 315.

17. The bispecific antigen binding protein of claim 16, wherein:
(a) LC2 comprises the sequence of SEQ ID NO: 211 and HC2 comprises the sequence of SEQ ID NO: 233, SEQ ID NO: 235, or SEQ ID NO: 236;
(b) LC2 comprises the sequence of SEQ ID NO: 212 and HC2 comprises the sequence of SEQ ID NO: 234;
(c) LC2 comprises the sequence of SEQ ID NO: 214 and HC2 comprises the sequence of SEQ ID NO: 237, SEQ ID NO: 239, or SEQ ID NO: 240;
(d) LC2 comprises the sequence of SEQ ID NO: 215 and HC2 comprises the sequence of SEQ ID NO: 238;
(e) LC2 comprises the sequence of SEQ ID NO: 216 and HC2 comprises the sequence of SEQ ID NO: 241, SEQ ID NO: 243, or SEQ ID NO: 244; or
(f) LC2 comprises the sequence of SEQ ID NO: 217 and HC2 comprises the sequence of SEQ ID NO: 242.

18. The bispecific antigen binding protein of claim 13, wherein LC1 comprises the sequence of SEQ ID NO: 275, HC1 comprises the sequence of SEQ ID NO: 306, LC2 comprises the sequence of SEQ ID NO: 216, and HC2 comprises the sequence of SEQ ID NO: 244.

19. The bispecific antigen binding protein of claim 13, wherein LC1 comprises the sequence of SEQ ID NO: 277, HC1 comprises the sequence of SEQ ID NO: 309, LC2 comprises the sequence of SEQ ID NO: 216, and HC2 comprises the sequence of SEQ ID NO: 243.

20. The bispecific antigen binding protein of claim 13, wherein LC1 comprises the sequence of SEQ ID NO: 276, HC1 comprises the sequence of SEQ ID NO: 308, LC2 comprises the sequence of SEQ ID NO: 217, and HC2 comprises the sequence of SEQ ID NO: 242.

21. The bispecific antigen binding protein of claim 13, wherein LC1 comprises the sequence of SEQ ID NO: 281, HC1 comprises the sequence of SEQ ID NO: 314, LC2 comprises the sequence of SEQ ID NO: 216, and HC2 comprises the sequence of SEQ ID NO: 241.

22. A pharmaceutical composition comprising the bispecific antigen binding protein of claim 13, and a pharmaceutically acceptable diluent, excipient or carrier.

23. A method for treating headache in a patient in need thereof, comprising administering to the patient an effective amount of the bispecific antigen binding protein of claim 13.

24. The bispecific antigen binding protein of claim 12, wherein the antibody is selected from the antibodies designated as iPS:326417, iPS:326626, iPS:326628, iPS:326631, iPS:326634, iPS:327870, iPS:327871, iPS:326645, iPS:326648, iPS:326651, iPS:326654, iPS:328000, iPS:328001, iPS:326661, iPS:326663, iPS:326666, iPS:326669, iPS:327017, iPS:327018, iPS:327019, iPS:327023, iPS:327024, iPS:327025, iPS:327026, iPS:327091, iPS:327092, iPS:327093, iPS:327094, iPS:326414, iPS:327102, iPS:327103, iPS:327104, iPS:327105, iPS:327106, iPS:327107, iPS:327108, iPS:327109, iPS:327110, iPS:327111, iPS:327112, iPS:327267, iPS:327268, iPS:327269, iPS:327270, iPS:327272, iPS:327273, iPS:327274, iPS:327275, iPS:327276, iPS:327277, iPS:327278, iPS:327279, iPS:327280, iPS:327281, iPS:327282, iPS:327283, iPS:327284, iPS:327285, iPS:327286, iPS:327287, iPS:327288, iPS:327289, iPS:327290, iPS:327291, iPS:327677, iPS:327678, iPS:327679, iPS:327680, iPS:327681, iPS:327682, iPS:327683, iPS:327684, iPS:327685, iPS:327686, iPS:327687, iPS:327688, iPS:327689, iPS:327690, iPS:327691, iPS:327693, iPS:327694, iPS:327696, iPS:327697, iPS:327698, iPS:327699, iPS:327700, iPS:327701, iPS:327702, iPS:327703, iPS:327704, iPS:327705, iPS:327706, iPS:327707, iPS:327708, iPS:327709, iPS:327710, iPS:327711, iPS:327712, iPS:327713, iPS:327714, iPS:327717, iPS:327718, iPS:327719, iPS:327721, iPS:327722, iPS:327724, iPS:327725, iPS:327726, iPS:327727, iPS:327728, iPS:327729, iPS:327730, iPS:327731, iPS:327732, iPS:327733, iPS:327734, iPS:327735, iPS:327736, iPS:327737, iPS:327738, iPS:327739, iPS:327740, iPS:327741, iPS:327742, iPS:327872, iPS:327874, iPS:327875, iPS:327876, iPS:327877, iPS:327878, iPS:327879, iPS:327880, iPS:327881, iPS:327882, iPS:327883, iPS:327884, iPS:327885, iPS:327886, iPS:327887, iPS:327888, iPS:327889, iPS:327890, iPS:327891, iPS:327892, iPS:327893, iPS:327894, iPS:327895, iPS:327896, iPS:327897, iPS:328031, iPS:328033, iPS:328034, iPS:328035, iPS:328036, iPS:328037, iPS:328038, iPS:328039, iPS:328040, iPS:328041, iPS:328042, iPS:328043, iPS:328044, iPS:328045, iPS:328046, iPS:328047, iPS:328048, iPS:328049, iPS:328050, or iPS:328051 as set forth in Table 8.

25. One or more isolated nucleic acids encoding the bispecific antigen binding protein of claim 1.

26. An expression vector comprising the one or more isolated nucleic acids of claim 25.

27. A cultured host cell comprising the vector of claim 26.

28. A method for the preparation of a bispecific antigen binding protein, comprising: culturing the host cell of claim 27 under conditions that allow expression of the antigen binding protein; and recovering the antigen binding protein from the culture.

29. A pharmaceutical composition comprising the bispecific antigen binding protein of claim 1, and a pharmaceutically acceptable diluent, excipient or carrier.

30. A method for treating headache in a patient in need thereof, comprising administering to the patient an effective amount of the bispecific antigen binding protein of claim 1.

31. The bispecific antigen binding protein of claim 1, wherein the binding protein comprises:
(i) the first binding domain that specifically binds to human CGRP receptor;
(ii) the second binding domain that specifically binds to human PAC1 receptor; and
(iii) a human immunoglobulin Fc region, wherein one of the binding domains is positioned at the amino terminus of the Fc region and the other binding domain is positioned at the carboxyl terminus of the Fc region.

32. The bispecific antigen binding protein of claim 31, wherein the carboxyl-terminal binding domain is a scFv and is fused at its amino terminus to the carboxyl terminus of the Fc region through a peptide linker.

33. The bispecific antigen binding protein of claim 32, wherein the variable regions are positioned in the scFv in a VH-VL or VL-VH orientation.

34. The bispecific antigen binding protein of claim 31, wherein the carboxyl-terminal binding domain is a Fab and is fused through a peptide linker to the carboxyl terminus of the Fc region.

35. The bispecific antigen binding protein of claim 34, wherein the Fab is fused to the Fc region through the amino terminus of the VL region of the Fab.

36. The bispecific antigen binding protein of claim 34, wherein the Fab is fused to the Fc region through the amino terminus of the VH region of the Fab.

37. The bispecific antigen binding protein of claim 31, wherein the amino-terminal binding domain is a Fab and is fused to the amino terminus of the Fc region through an immunoglobulin hinge region.

38. The bispecific antigen binding protein of claim 37, wherein the amino-terminal Fab is fused to the Fc region through the carboxyl terminus of the CH1 region of the Fab.

39. The bispecific antigen binding protein of claim 31, wherein the first domain that specifically binds to human CGRP receptor is positioned at the amino terminus of the Fc region and the second domain that specifically binds to human PAC1 receptor is positioned at the carboxyl terminus of the Fc region.

40. The bispecific antigen binding protein of claim 31, wherein the second domain that specifically binds to human PAC1 receptor is positioned at the amino terminus of the Fc region and the first domain that specifically binds to human CGRP receptor is positioned at the carboxyl terminus of the Fc region.

41. The bispecific antigen binding protein of claim 31, wherein the Fc region comprises a CH2 domain and a CH3 domain from a human IgG1 or IgG2 immunoglobulin.

42. A pharmaceutical composition comprising the bispecific antigen binding protein of claim 31, and a pharmaceutically acceptable diluent, excipient or carrier.

43. A method for treating headache in a patient in need thereof, comprising administering to the patient an effective amount of the bispecific antigen binding protein of claim 31.

* * * * *

UNITED STATES PATENT AND TRADEMARK OFFICE
CERTIFICATE OF CORRECTION

| | |
|---|---|
| PATENT NO. | : 10,934,362 B2 |
| APPLICATION NO. | : 15/511176 |
| DATED | : March 2, 2021 |
| INVENTOR(S) | : Kannan et al. |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 238 days.

Signed and Sealed this
Fourteenth Day of February, 2023

*Katherine Kelly Vidal*

Katherine Kelly Vidal
*Director of the United States Patent and Trademark Office*